US009714418B2

(12) United States Patent
Amick et al.

(10) Patent No.: US 9,714,418 B2
(45) Date of Patent: Jul. 25, 2017

(54) MODIFIED SANTALENE SYNTHASE POLYPEPTIDES, ENCODING NUCLEIC ACID MOLECULES AND USES THEREOF

(71) Applicant: ALLYLIX, INC., San Diego, CA (US)

(72) Inventors: Jean Davin Amick, Lexington, KY (US); Bryan N. Julien, Lexington, KY (US)

(73) Assignee: Evolva, Inc., Lexington, KY (US)

( * ) Notice: Subject to any disclaimer, the term of this patent is extended or adjusted under 35 U.S.C. 154(b) by 0 days.

(21) Appl. No.: 14/673,720

(22) Filed: Mar. 30, 2015

(65) Prior Publication Data

US 2015/0275196 A1    Oct. 1, 2015

Related U.S. Application Data

(60) Provisional application No. 61/973,148, filed on Mar. 31, 2014.

(51) Int. Cl.
| | | |
|---|---|---|
| C12N 1/16 | (2006.01) |
| C12N 1/21 | (2006.01) |
| C12N 9/88 | (2006.01) |
| C12P 5/00 | (2006.01) |
| C12N 15/60 | (2006.01) |
| C12N 15/70 | (2006.01) |
| C12N 15/79 | (2006.01) |

(52) U.S. Cl.
CPC .............. *C12N 9/88* (2013.01); *C12P 5/007* (2013.01); *C12Y 402/03082* (2013.01); *C12Y 402/03083* (2013.01)

(58) Field of Classification Search
None
See application file for complete search history.

(56) References Cited

U.S. PATENT DOCUMENTS

| | | |
|---|---|---|
| 6,468,772 B1 | 10/2002 | Chappell et al. |
| 6,495,354 B2 | 12/2002 | Chappell et al. |
| 6,531,303 B1 | 3/2003 | Millis et al. |
| 6,559,297 B2 | 5/2003 | Chappell et al. |
| 6,689,593 B2 | 2/2004 | Millis et al. |
| 7,838,279 B2 | 11/2010 | Millis et al. |
| 7,842,497 B2 | 11/2010 | Millis et al. |
| 7,906,710 B2 | 3/2011 | Karunanandaa et al. |
| 8,569,025 B2 | 10/2013 | Zulak et al. |
| 2004/0249219 A1 | 12/2004 | Saucy |
| 2009/0123984 A1 | 5/2009 | Chappell et al. |
| 2010/0151519 A1 | 6/2010 | Julien et al. |
| 2011/0008836 A1 | 1/2011 | Schalk |
| 2011/0189717 A1 | 8/2011 | Ajikumar et al. |
| 2011/0281257 A1* | 11/2011 | Schalk .................... C12P 5/007 435/4 |
| 2012/0208173 A1* | 8/2012 | Zulak ....................... C12N 9/88 435/4 |
| 2012/0246767 A1 | 9/2012 | Amick et al. |

FOREIGN PATENT DOCUMENTS

| | | |
|---|---|---|
| WO | WO 2006/134523 A2 | 12/2006 |
| WO | WO 2010/067309 A1 | 6/2010 |
| WO | WO 2011/000026 A1 | 1/2011 |
| WO | WO 2012/058636 A1 | 5/2012 |

OTHER PUBLICATIONS

Gustafsson et al., Codon bias and heterologous protein expression, Trends Biotech., 2004, 22, 346-53.*
Chang et al., Engineering *Escherichia coli* for production of functionalized terpenoids using plant P450s, Nature Chem. Biol., 2007, 3, 274-77.*
International Search Report of the International Bureau on behalf of the International Searching Authority for International Application No. PCT/US2015/023412 issued Nov. 3, 2015, pp. 1-7.
Carillo and Lipman "The multiple sequence alignment problem in biology," SIAM J Appl Math., 48:1073-1082 (1988).
IUPAC-IUB Commission on Biochemical Nomenclature. A one-letter notation for amino acid sequences. Tentative Rules, J. Biol. Chem., 243(13):3557-3559 (1968).
Altschul, "Amino acid substitution matrices from an information theoretic perspective," J Mol. Biol., 219:555-65 (1991).
Gribskov and Burgess, "Sigma factors from *E. coli*, B. subtilis, phage SP01, and phage T4 are homologous proteins," Nucl. Acids Res., 14(16):6745-6763 (1986).
Huang and Miller, "A time-efficient, linear-space local similarity algorithm," Adv. Appl. Math, 12:337-357 (1991).
Needleman and Wunsch, "A general method applicable to the search for similarities in the amino acid sequence of hero proteins," J Mol. Biol., 48: 443-453 (1970).
Smith and Waterman, "Comparison of Biosequences," Adv. Appl. Math, 2: 482-489 (1981).
Jones et al., "Sandalwood Fragrance Biosynthesis Involves Sesquiterpene Synthases of Both the Terpene Synthase (TPS)-a and TPS-b Subfamilies, including Santalene Synthases," J Biol. Chem., 286(20):17445-17454 (2011).
Sallaud et al., "A Novel Pathway for Sesquiterpene Biosynthesis from Z,Z-Farnesyl Pyrophosphate in the Wild Tomato *Solanum habrochaites*," Plant Cell, 21:301-317 (2009).
Diaz-Chavez et al., "Biosynthesis of Sandalwood Oil: Santalum album CYP76F cytochromes P450 produce santalols and bergamotol," PLoS One, 8(9):e75053 (2013).
Chen et al., "The family of terpene synthases in plants: a mid-size family of genes for specialized metabolism that is highly diversified throughout the kingdom," Plant J., 66:212-229 (2011).
Starks et al., "Structural basis for cyclic terpene biosynthesis by tobacco 5-epi-aristolochene synthase," Science, 277:1815-1820 (1997).
Lesburg et al., "Crystal structure of pentalenene synthase: mechanistic insights on terpenoid cyclization reactions in biology," Science, 277:1820-1824 (1997).
Degenhardt et al., "Monoterpene and sesquiterpene synthases and the origin of terpene skeletal diversity in plants," Phytochem., 70:1621-1637 (2009).

(Continued)

*Primary Examiner* — Robert Mondesi
*Assistant Examiner* — Todd M Epstein
(74) *Attorney, Agent, or Firm* — McDonnell Boehnen Hulbert & Berghoff LLP

(57) ABSTRACT

Provided are modified santalene synthase polypeptides, nucleic acid molecules encoding the modified santalene synthase polypeptides, and methods of using the modified santalene synthase polypeptides. The modified santalene synthase polypeptides include those that catalyze production of increased levels of terpenes or altered profiles thereof or both.

25 Claims, 11 Drawing Sheets

(56) References Cited

OTHER PUBLICATIONS

Wymore et al., "A Mechanism for Evolving Novel Plant Sesquiterpene Synthase Function," Mol. Inf., 30:896-906 (2011).
Bohlmann et al., "Plant terpenoid synthases: molecular biology and phylogenetic analysis," Proc. Natl. Acad. Sci. U.S.A., 95:4126-4133 (1998).
Whittington et al., "Bornyl diphosphate synthase: structure and strategy for carbocation manipulation by a terpenoid cyclase," Proc. Natl. Acad. Sci. U.S.A., 99(24): 15375-15380 (2002).
Li et al., "Rational engineering of plasticity residues of sesquiterpene synthases from Artemisia annua: product specificity and catalytic efficiency," Biochem. J., 451:417-426 (2013).
Rani et al., "Molecular regulation of santalol biosynthesis in Santalum album L," Gene, 527:642-648 (2013).
Williams et al., "Truncation of limonene synthase preprotein provides a fully active 'pseudomature' form of this monoterpene cyclase and reveals the function of the amino-terminal arginine pair," Biochemistry, 37:12213-20 (1998).
Forsburg, "Codon usage table for Schizosaccharomyces pombe," Yeast, 10:1045-1047 (1994).
Brown et al., "Codon utilisation in the pathogenic yeast, *Candida albicans*," Nucleic Acids Research, 19(15):4298 (1991).
Sharp et al., "Codon usage patterns in *Escherichia coli*, Bacillus subtilis, *Saccharomyces cerevisiae*, Schizosaccharomyces pombe, *Drosophila melanogaster* and *Homo sapiens*; a review of the considerable within-species diversity," Nucleic Acids Res., 16(17):8207-8211 (1988).
Sharp and Cowe, "Synonymous codon usage in *Saccharomyces cerevisiae*," Yeast, 7:657-78 (1991).
Jay et al., "Construction of a general vector for efficient expression of mammalian proteins in bacteria: use of a synthetic ribosome binding site," Proc. Natl. Acad. Sci. USA, 78(9):5543-48 (1981).
Deboer et al., "The tac promoter: a functional hybrid derived from the trp and lac promoters," Proc. Natl. Acad. Sci. USA, 80:21-25 (1983).
Gilbert and Villa-Komaroff, "Useful Proteins from Recombinant Bacteria," Scientific American, 242(4):74-94 (1980).
Hitzeman et al., "Isolation and characterization of the yeast 3-phosphoglycerokinase gene (PGK) by an Immunological screening technique," J. Biol. Chem., 255(24):12073-80 (1980).
Hess et al., "Cooperation of glycolytic enzymes," J. Adv. Enzyme Reg., 7:149-67 (1968).
Holland and Holland, "Isolation and identification of yeast messenger ribonucleic acids coding for enolase, glyceraldehyde-3-phosphate dehydrogenase, and phosphoglycerate kinase," Biochem., 17(23):4900-7 (1978).
Fleer et al., "High-level secretion of correctly processed recombinant human interleukin-1 beta in Kluyveromyces lactis," Gene, 107:285-95 (1991).
Van Den Berg et al., "Kluyveromyces as a host for heterologous gene expression: expression and secretion of brochymosin," Bio/Technology, 8:135-139 (1990).
Russell et al., "Nucleotide sequence of the yeast alcohol dehydrogenase II gene," J. Biol. Chem., 258(4):2674-82 (1983).
Beier and Young, "Characterization of a regulatory region upstream of the ADR2 locus of S. cerevisiae," Nature, 300:724-28 (1982).
Pompon et al., "Genetically engineered yeast cells and their applications," Toxicology Letters, 82/83:815-822 (1995).
Ro et al., "Loblolly pine abietadienol/abietadienal oxidase PtAO (CYP720B1) is a multifunctional, multisubstrate cytochrome P450 monooxygenase," Proc. Natl. Acad. Sci. USA, 102(22):8060-8065 (2005).
Mayfield et al., "Expression and assembly of a fully active antibody in algae," Proc. Natl. Acad. Sci. USA, 100 (2):438-442 (2003).
Muneta et al., "Large-scale production of porcine mature interleukin-18 (IL-18) in silkworms using a hybrid baculovirus expression system," J Vet. Afed. Sci., 65(2):219-223 (2003).
Mizutani and Ohta, "Two isoforms of NADPH:cytochrome P450 reductase in Arabidopsis thaliana. Gene structure, heterologous expression in insect cells, and differential regulation," Plant Physiology, 116:357-367 (1998).
Pham et al., "Large-scale transient transfection of serum-free suspension-growing HEK293 EBNA1 cells: peptone additives improve cell growth and transfection efficiency," Biotechnol. Bioeng., 84(3):332-42 (2003).
Takahashi et al., "Metabolic engineering of sesquiterpene metabolism in yeast," Biotechnol Bioeng., 97(1): 170-181 (2007).
Genbank: Accession No. ADP30867 "Santalene bergamotene synthase 2 [Santalum album]," published on Nov. 6, 2010 [retrieved on Nov. 28, 2016] [retrieved from the internet https://www.ncbi.nlm.nih.gov/protein/ADP30867][2 pages].
Genbank Accession No. HQ343278 "Santalum spicatum santalene synthase mRNA, complete cds," published on May 17, 2011 [retrived on Nov. 28, 2016] [retrieved from the internet https://www.ncbi.nlm.nih.gov/nuccore/HQ343278] [2 pages].
Genbank Accession No. HQ343277 "Santalum austrocaledonicum santalene synthase mRNA, complete cds," published on May 17, 2011 [retrieved on Nov. 28, 2016] [retrieved from the internet https://www.ncbi.nlm.nih.gov/nuccore/HQ343277] [2 pages].

* cited by examiner

```
SEQIDNO_1   MDSSTATAMTAPFIDPTDHVNLKTDTDSENRRMGNYKPSIWNYDFLQSLATHHNIVEER 60
SEQIDNO_27  MDSSTATAMTAPFIDPTDHVNLKTDTDSENRRMGNYKPSIWNYDFLQSLATHHNIVEER 60
            ******************************************************

SEQIDNO_1   HLKLAEKLKGQVKFMFGAPMEPLAKLELVDVVQRLGLNHLFETEIKEALFSIYKDGSNGW 120
SEQIDNO_27  HLKLAEKLKGQVKFMFGAPMEPLAKLELVDVVQRLGLNHLFETEIKEALFSIYKDGSNGW 120
            ******************************************************

SEQIDNO_1   WFGHLHATSLRFRLLRQCGLFIPQDVFKTFQNKTGEFDMKLCDNVKGLLSLYEASYLGWK 180
SEQIDNO_27  WFGHLHATSLRFRLLRQCGLFIPQDVFKTFQNKTGEFDMKLWDNVKGLLSLYEASYLGWK 180
            ***************************************  *****************

SEQIDNO_1   GENILDEAKAFTTKCLKSAWENISEKWLAKRVKHALALPLHWRVPRIEARWFIEAYEQEA 240
SEQIDNO_27  GENILDEAKAFTTKCLKSAWENISEKWLAKRVKHALALPLHWRVPRIEARWFIEVYEQEA 240
            *****************************************************.*****

SEQIDNO_1   NMNPTLLKLAKLDFNMVQSIHQKEIGELARWWVTTGLDKLAARNNLLQSYMWSCAIASD 300
SEQIDNO_27  NMNPTLLKLAKLDFNMVQSIHQKEIGELARWWVTTGLDKLDARNNLLQSYMWSCAIASD 300
            ****************************************  *****************

SEQIDNO_1   PKFKLARETIVEIGSVLTVVDDGYDVYGSIDELDLYTSSVERWSEIDKLPNTLKLIFM 360
SEQIDNO_27  PKFKLARETIVEIGSVLTVVDDGYDVYGSMDELDLYTSSVERWSKIDKLPNTLKLIFM 360
            *****************************:*************:*************

SEQIDNO_1   SMFNKTNEVGLRVQHERGYNSIPTFIKAWVEQCKSYQKEARWFHGGHTPPLEEYSLNGLV 420
SEQIDNO_27  SMFNKTNEVGLRVQHERGYNSIPTFIKAWVEQCKSYQKEARWFHGGHTPPLEEYSLNGLV 420
            ******************************************************

SEQIDNO_1   SIGFPLLLITGYVAIAENEAALDKVHPLPDLLHYSSLLSRLINDIGTSPDEMARGDNLKS 480
SEQIDNO_27  SIGFPLLLITGYVAIAENEAALDKVHPLPDLLHYSSLLSRLINDIGTSPDEMARGDNLKS 480
            ******************************************************

SEQIDNO_1   IHYMNETGASEEVAREHIKGVIEENWKILNQCCFDQSQFQEPFITFNLNSVRGSHFFYE 540
SEQIDNO_27  IHYMNETGASEEVAREHIKGVIEENWKILNQCCFDQSQFQEPFITFNLNSVRGSHFFYE 540
            ******************************************************

SEQIDNO_1   FGDGFGVDSWTKVDMKSVLIDPIPLGEE 569
SEQIDNO_27  FGDGFGVDSWTKVDMKSVLIDPIPLGEE 569
            ****************************
```

Figure 2A

```
SEQIDNO_1   MDSSTATAMTAPFIDPTDHVNLKTDTD SENRRMGNYKPSIWNYDFLQSLATHHNIVEER  60
SEQIDNO_28  MDSSTATAMTAPFIDPTDHVNLKTDTD SENRRMGNYKPSIWNYDFLQSLATHHNIVEER  60
            *************************** ********************************

SEQIDNO_1   HLKLAEKLKGQVKFMFGAPMEPLAKLELVDVVQRLGLNHLFETEIKEALFSIYKDGSNGW 120
SEQIDNO_28  HLKLAEKLKGQVKFMFGAPMEPLAKLELVDVVQRLGLNHLFETEIKEALFSIYKDGSNGW 120
            ************************************************************

SEQIDNO_1   WFGHLHATSLRFRLLRQCGLFIPQDVFKTFQNKTGEFDMKLCDNVKGLLSLYEASYLGWK 180
SEQIDNO_28  WFGHLHATSLRFRLLRQCGLFIPQDVFKTFQNKTGEFDMKLWDNVKGLLSLYEASYLGWK 180
            ***************************************** ******************

SEQIDNO_1   GENILDEAKAFTTKCLKSAWENISEKWLAKRVKHALALPLHWRVPRIEARWFIEAYEQEA 240
SEQIDNO_28  GENILDEAKAFTTKCLKSAWENISEKWLAKRVKHALALPLHWRVPRIEARWFIEVYEQEA 240
            *****************************************************.*****

SEQIDNO_1   NMNPTLLKLAKLDFNMVQSIHQKEIGELARWWVTTGLDKLA ARNNLLQSYMWSCAIASD 300
SEQIDNO_28  NMNPTLLKLAKLDFNMVQSIHQKEIGELARWWVTTGLDKLD ARNNLLQSYMWSCPIASD 300
            ****************************************  ***********.****

SEQIDNO_1   PKFKLARETIVEIGSVLTVVDDGYDVYGSIDELDLYTSSVERWS EIDKLPNTLKLIFM 360
SEQIDNO_28  PKFKLARETIVEIGSVLTVVDDGYDVYGSMDELDLYTSSVERWS KIDKLPNTLKLIFM 360
            *****************************:*************  *:************

SEQIDNO_1   SMFNKTNEVGLRVQHERGYNSIPTFIKAWVEQCKSYQKEARWFHGGHTPPLEEYSLNGLV 420
SEQIDNO_28  SMFNKTNEVGLRVQHERGYNSIPTFIKAWVEQCKSYQKEARWFHGGHTPPLEEYSLNGLV 420
            ************************************************************

SEQIDNO_1   SIGFPLLLITGYVAIAENEAALDKVHPLPDLLHYSSLLSRLINDIGTSPDEMARGDNLKS 480
SEQIDNO_28  SIGFPLLLITGYVAIAENEAALDKVHPLPDLLHYSSLLSRLINDIGTSPDEMARGDNLKS 480
            ************************************************************

SEQIDNO_1   IH YMNETGASEEVAREHIKGVIEENWKILNQCCFDQSQFQEPFITFNLNSVRGSHFFYE 540
SEQIDNO_28  IH YMNETGASEEVAREHIKGVIEENWKILNQCCFDQSQFQEPFITFNLNSVRGSHFFYE 540
            ** *********************************************************

SEQIDNO_1   FGDGFGV DSWTKVDMKSVLIDPIPLGEE 569
SEQIDNO_28  FGDGFGV DSWTKVDMKSVLIDPIPLGEE 569
            ******* *********************
```

Figgure 2B

```
SEQIDNO_1   MDSSTATAMTAPFIDPTDHVNLKTDTDXSENRRMGNYKPSIWNYDFLQSLATHHNIVEER  60
SEQIDNO_29  MDSSTATAMRAPFIDHTDHVNLRTDNDXSENRRMGNYKPSIWNYDFLQSLATRHNIMEER  60
            ********* ***** ******:**.*:********************** :***:***

SEQIDNO_1   HLKLAEKLKGQVKFMFGAPMEPLAKLELVDVVQRLGLNHLFETEIKEALFSIYKDGSNGW  120
SEQIDNO_29  HLKLAEKLKGQVKFMFGAPMEPLAKLELVDVVQRLGLNHRFETEIKEALFSIYKDESNGW  120
            ****************************************** *************** ****

SEQIDNO_1   WFGHLHATSLRFRLLRQCGLFIPQDVFKTFQNKTGEFDMKLCDNVKGLLSLYEASYLGWK  180
SEQIDNO_29  WFGHLHATSLRFRLLRQCGLFIPQDVFKTFQSKTGEFDMKLCDNVKGLLSLYEASFLGWR  180
            *******************************.************************:***:

SEQIDNO_1   GENILDEAKAFTTKCLKSAWENISEKWLAKRVKHALALPLHWRVPRIEARWFIEAYEQEA  240
SEQIDNO_29  DENILDEAKAFATKYLKNAWENISQKWLAKRVKHALALPLHWRVPRIEARWFVEAYGEEE  240
            .**********:** ** .*****:*************************** :*** :*

SEQIDNO_1   NMNPTLLKLAKLDFNMVQSIHQKEIGELARWWVTTGLDKLAXARNNLLQSYMWSCAIASD  300
SEQIDNO_29  NMNPTLLKLAKLDFNMVQSIHQKEIGELARWWVTTGLDKLAXARNNLLQSYMWSCAIASD  300
            ************************************************************

SEQIDNO_1   PKFKLARETIVEIGSVLTVVDDGYDVYGSIDELDLYTSSVERWSXXEIDKLPNTLKLIFM  360
SEQIDNO_29  PKFKLARETIVEIGSVLTVVDDAYDVYGSMDELDLYTNSVERWSXXEIDKLPNTLKLIFM  360
            **********************.******:******.*******..*************

SEQIDNO_1   SMFNKTNEVGLRVQHERGYNSIPTFIKAWVEQCKSYQKEARWFHGGHTPPLEEYSLNGLV  420
SEQIDNO_29  AMFNKTNEVGLRVQHERGYSGITTFIKAWVEQCKSYQKEARWYHGGHTPPLEEYSLNGLV  420
            :******************..*.*******************:*****************

SEQIDNO_1   SIGFPLLLITGYVAIAENEAALDKVHPLPDLLHYSSLLSRLINDIGTSPDEMARGDNLKS  480
SEQIDNO_29  SIGFPLLLITGYVAIAENEAALDKVHPLPDLLHYSSLLSRLINDMGTSSDELERGDNLKS  480
            ********************************************:***.**: ******

SEQIDNO_1   IHXYMNETGASEEVAREHIKGVIEENWKILNQCCFDQSQFQEPFITFNLNSVRGSHFFYE  540
SEQIDNO_29  IQXYMNQTGASEKVAREHIKGIIEENWKILNECCFDQSQFQEPFVTFNLNSVRGSHFFYE  540
            *:****:*****:********:*********:************:***************

SEQIDNO_1   FGDGFGVXDSWTKVDMKSVLIDPIPLGEE  569
SEQIDNO_29  FGDGFGVXNSWTKVDMKSVLIDPIPLDEE  569
            *******:*****************.**
```

Figure 2C

```
SEQIDNO_1    MDSSTATAMTAPFIDPTDHVNLKTDTDSENRRMGNYKPSIWNYDFLQSLATHHNIVEER  60
SEQIDNO_30   MDSSTATAMRAPFIDHTDHVNLRTDNDSENRRMGNYKPSIWNYDFLQSLATRHNIMEER  60
             ********* ***** ******:**.*:******************.***.***

SEQIDNO_1    HLKLAEKLKGQVKFMFGAPMEPLAKLELVDVVQRLGLNHLFETEIKEALFSIYKDGSNGW  120
SEQIDNO_30   HLKLAEKLKGQVKFMFGAPMEPLAKLELVDVVQRLGLNHRFETEIKEALFSIYKDESNGW  120
             *************************************** ****************:****

SEQIDNO_1    WFGHLHATSLRFRLLRQCGLFIPQDVFKTFQNKTGEFDMKLCDNVKGLLSLYEASYLGWK  180
SEQIDNO_30   WFGHLHATSLRFRLLRQCGLFIPQDVFKTFQSKTGEFDMKLCDNVKGLLSLYEASFLGWR  180
             *******************************.**********************:***:

SEQIDNO_1    GENILDEAKAFTTKCLKSAWENISEKWLAKRVKHALALPLHWRVPRIEARWFIEAYEQEA  240
SEQIDNO_30   DENILDEAKAFATKYLKNAWENISQKWLAKRVKHALALPLHWRVPRIEARWFVEAYGEEE  240
             .**********:** **.******:***************************:***.:*

SEQIDNO_1    NMNPTLLKLAKLDFNMVQSIHQKEIGELARWWVTTGLDKLAARNNLLQSYMWSCAIASD  300
SEQIDNO_30   NMNPTLLKLAKLDFNMVQSIHQKEIGELARWWVTTGLDKLAARNNLLQSYMWSCAIASD  300
             ************************************************************

SEQIDNO_1    PKFKLARETIVEIGSVLTVVDDGYDVYGSIDELDLYTSSVERWSEIDKLPNTLKLIFM  360
SEQIDNO_30   PKFKLARETIVEIGSVLTVVDDAYDVYGSMDELDLYTNSVERWSEIDKLPNTLKLIFM  360
             **********************.******.******:******.***************

SEQIDNO_1    SMFNKTNEVGLRVQHERGYNSIPTFIKAWVEQCKSYQKEARWFHGGHTPPLEEYSLNGLV  420
SEQIDNO_30   SMFNKTNEVGLRVQHERGYSGITTFIKAWVEQCKSYQKEARWYHGGHTPPLEEYSLNGLV  420
             *******************..*.*******************:*****************

SEQIDNO_1    SIGFPLLLITGYVAIAENEAALDKVHPLPDLLHYSSLLSRLINDIGTSPDEMARGDNLKS  480
SEQIDNO_30   SIGFPLLLITGYVAIAENEAALDKVHPLPDLLHYSSLLSRLINDMGTSSDELERGDNLKS  480
             ********************************************:***.**: ******

SEQIDNO_1    IHYMNETGASEEVAREHIKGVIEENWKILNQCCFDQSQFQEPFITFNLNSVRGSHFFYE  540
SEQIDNO_30   IQYMNQTGASEKVAREHIKGIIEENWKILNECCFDQSQFQEPFVTFNLNSVRGSHFFYE  540
             *:****.*****:*******:*******.************:*****************

SEQIDNO_1    FGDGFGVDSWTKVDMKSVLIDPIPLGEE  569
SEQIDNO_30   FGDGFGVDSWTKVDMKSVLIDPIPLDEE  569
             ************************.**
```

Figure 2D

```
SEQIDNO_1   MDSSTATAMTAPFIDPTDHVNLKTDTDSENRRMGNYKPSIWNYDFLQSLATHHNIVEER 60
SEQIDNO_31  ------------------MATLKTDTDSENRRMGNYKPSIWNYDFLQSLATHHNIVEER 42
                              .  .************************************

SEQIDNO_1   HLKLAEKLKGQVKFMFGAPMEPLAKLELVDVVQRLGLNHLFETEIKEALFSIYKDGSNGW 120
SEQIDNO_31  HLKLAEKLKGQVKFMFGAPMEPLAKLELVDVVQRLGLNHLFETEIKEALFSIYKDGSNGW 102
            ************************************************************

SEQIDNO_1   WFGHLHATSLRFRLLRQCGLFIPQDVFKTFQNKTGEFDMKLCDNVKGLLSLYEASYLGWK 180
SEQIDNO_31  WFGHLHATSLRFRLLRQCGLFIPQDVFKTFQNKTGEFDMKLWDNVKGLLSLYEASYLGWK 162
            ***************************************** *****************

SEQIDNO_1   GENILDEAKAFTTKCLKSAWENISEKWLAKRVKHALALPLHWRVPRIEARWFIEAYEQEA 240
SEQIDNO_31  GENILDEAKAFTTKCLKSAWENISEKWLAKRVKHALALPLHWRVPRIEARWFIEVYEQEA 222
            ******************************************************.*****

SEQIDNO_1   NMNPTLLKLAKLDFNMVQSIHQKEIGELARWWVTTGLDKLAARNNLLQSYMWSCAIASD 300
SEQIDNO_31  NMNPTLLKLAKLDFNMVQSIHQKEIGELARWWVTTGLDKLDARNNLLQSYMWSCAIASD 282
            **************************************** *******************

SEQIDNO_1   PKFKLARETIVEIGSVLTVVDDGYDVYGSIDELDLYTSSVERWSEIDKLPNTLKLIFM 360
SEQIDNO_31  PKFKLARETIVEIGSVLTVVDDGYDVYGSMDELDLYTSSVERWSKIDKLPNTLKLIFM 342
            *****************************.*************:*************

SEQIDNO_1   SMFNKTNEVGLRVQHERGYNSIPTFIKAWVEQCKSYQKEARWFHGGHTPPLEEYSLNGLV 420
SEQIDNO_31  SMFNKTNEVGLRVQHERGYNSIPTFIKAWVEQCKSYQKEARWFHGGHTPPLEEYSLNGLV 402
            ************************************************************

SEQIDNO_1   SIGFPLLLITGYVAIAENEAALDKVHPLPDLLHYSSLLSRLINDIGTSPDEMARGDNLKS 480
SEQIDNO_31  SIGFPLLLITGYVAIAENEAALDKVHPLPDLLHYSSLLSRLINDIGTSPDEMARGDNLKS 462
            ************************************************************

SEQIDNO_1   IHYMNETGASEEVAREHIKGVIEENWKILNQCCFDQSQFQEPFITFNLNSVRGSHFFYE 540
SEQIDNO_31  IHYMNETGASEEVAREHIKGVIEENWKILNQCCFDQSQFQEPFITFNLNSVRGSHFFYE 522
            ************************************************************

SEQIDNO_1   FGDGFGVDSWTKVDMKSVLIDPIPLGEE 569
SEQIDNO_31  FGDGFGVDSWTKVDMKSVLIDPIPLGEE 551
            ****************************
```

Figure 2E

```
SEQIDNO_1      MDSSTATAMTAPFIDPTDHVNLKTDTDASENRRMGNYKPSIWNYDFLQSLATHHNIVEER  60
SEQIDNO_32     -------------------MATDNDSENRRMGNYKPSIWNYDFLQSLATRHNIMEER     39
                                         :  **.*:*****************************:***:***

SEQIDNO_1      HLKLAEKLKGQVKFMFGAPMEPLAKLELVDVVQRLGLNHLFETEIKEALFSIYKDGSNGW  120
SEQIDNO_32     HLKLAEKLKGQVKFMFGAPMEPLAKLELVDVVQRLGLNHRFETEIKEALFSIYKDESNGW   99
                ******************************************* ****************** ****

SEQIDNO_1      WFGHLHATSLRFRLLRQCGLFIPQDVFKTFQNKTGEFDMKLCDNVKGLLSLYEASYLGWK  180
SEQIDNO_32     WFGHLHATSLRFRLLRQCGLFIPQDVFKTFQSKTGEFDMKLCDNVKGLLSLYEASFLGWR  159
                *******************************.*****************************:***:

SEQIDNO_1      GENILDEAKAFTTKCLKSAWENISEKWLAKRVKHALALPLHWRVPRIEARWFIEAYEQEA  240
SEQIDNO_32     DENILDEAKAFATKYLKNAWENISQKWLAKRVKHALALPLHWRVPRIEARWFVEAYGEEE  219
                .**********:** **.******:***********************************:*** .:*

SEQIDNO_1      NMNPTLLKLAKLDFNMVQSIHQKEIGELARWWVTTGLDKLAARNNLLQSYMWSCAIASD  300
SEQIDNO_32     NMNPTLLKLAKLDFNMVQSIHQKEIGELARWWVTTGLDKLAARNNLLQSYMWSCAIASD  279
                ***********************************************************

SEQIDNO_1      PKFKLARETIVEIGSVLTVVDDGYDVYGSIDELDLYTSSVERWSEIDKLPNTLKLIFM  360
SEQIDNO_32     PKFKLARETIVEIGSVLTVVDDAYDVYGSMDELDLYTNSVERWSEIDKLPNTLKLIFM  339
                **********************.******:******.:********.***************

SEQIDNO_1      SMFNKTNEVGLRVQHERGYNSIPTFIKAWVEQCKSYQKEARWFHGGHTPPLEEYSLNGLV  420
SEQIDNO_32     AMFNKTNEVGLRVQHERGYSGITTFIKAWVEQCKSYQKEARWYHGGHTPPLEEYSLNGLV  399
                :******************. .* ******************:*****************

SEQIDNO_1      SIGFPLLLITGYVAIAENEAALDKVHPLPDLLHYSSLLSRLINDIGTSPDEMARGDNLKS  480
SEQIDNO_32     SIGFPLLLITGYVAIAENEAALDKVHPLPDLLHYSSLLSRLINDMGTSSDELERGDNLKS  459
                ********************************************:*** **: *******

SEQIDNO_1      IHYMNETGASEEVAREHIKGVIEENWKILNQCCFDQSQFQEPFITFNLNSVRGSHFFYE  540
SEQIDNO_32     IQYMNQTGASEKVAREHIKGIIEENWKILNECCFDQSQFQEPFVTFNLNSVRGSHFFYE  519
                *:****.*****:*******:*********:***********:.***************

SEQIDNO_1      FGDGFGVDSWTKVDMKSVLIDPIPLGEE  569
SEQIDNO_32     FGDGFGVNSWTKVDMKSVLIDPIPLDEE  548
                *******:*****************.**
```

Figure 2F

```
SEQIDNO_1   MDSSTATAMTAPFIDPTDHVNLKTDTD SENRRMGNYKPSIWNYDFLQSLATHHNIVEER 60
SEQIDNO_10  MDSSTATATTAPFIDHTDHVNLKIDND SESRRMGNYKPSIWNYDFLQSLAIHHNIVEEK 60
            ******* ****** ******* *.*:**.********************* ******:

SEQIDNO_1   HLKLAEKLKGQVKFMFGAPMEPLAKLELVDVVQRLGLNHLFETEIKEALFSIYKDGSNGW 120
SEQIDNO_10  HLKLAEKLKGQVMSMFGAPMEPLAKLELVDVVQRLGLNHQFETEIKEALFSVYKDGSNGW 120
            ************ ************************** ***********:*******

SEQIDNO_1   WFGHLHATSLRFRLLRQCGLFIPQDVFKTFQNKTGEFDMKLCDNVKGLLSLYEASYLGWK 180
SEQIDNO_10  WFGHLHATSLRFRLLRQCGLFIPQDVFKTFQSKTDEFDMKLCDNIKGLLSLYEASFLGWK 180
            *******************************.**.********:*********:****

SEQIDNO_1   GENILDEAKAFTTKCLKSAWENISEKWLAKRVKHALALPLHWRVPRIEARWFIEAYEQEA 240
SEQIDNO_10  GENILDEAKAFATKYLKNAWENISQKWLAKRVKHALALPLHWRVPRIEARWFIEAYEQEE 240
            ***********:** **.******:***********************************

SEQIDNO_1   NMNPTLLKLAKLDFNMVQSIHQKEIGELARWWVTTGLDKLA ARNNLLQSYMWSCAIASD 300
SEQIDNO_10  NMNPTLLKLAKLDFNMVQSIHQKEIGELARWWVTTGLDKLA ARNNLLQSYMWSCAIASD 300
            ******************************************* ****************

SEQIDNO_1   PKFKLARETIVEIGSVLTVVDDGYDVYGSIDELDLYTSSVERWS EIDKLPNTLKLIFM 360
SEQIDNO_10  PKFKLARETIVEIGSVLTVVDDAYDVYGSMDELDHYTYSVERWS EIDKLPNTLKLIFM 360
            **********************.******:****:**:*******  *************

SEQIDNO_1   SMFNKTNEVGLRVQHERGYNSIPTFIKAWVEQCKSYQKEARWFHGGHTPPLEEYSLNGLV 420
SEQIDNO_10  SMFNKTNEVGLRVQHERGYNGIPTFIKAWVEQCKAYQKEARWYHGGHTPPLEEYSLNGLV 420
            ********************.*************:****** *****************

SEQIDNO_1   SIGFPLLLITGYVAIAENEAALDKVHPLPDLLHYSSLLSRLINDIGTSPDEMARGDNLKS 480
SEQIDNO_10  SIGFPLLLITGYIAIAENEAALDKVHPLPDLLHYSSLLSRLINDMGTSPDEMARGDNLKS 480
            ************:*******************************:***************

SEQIDNO_1   IH YMNETGASEEVAREHIKGVIEENWKILNQCCFDQSQFQEPFITFNLNSVRGSHFFYE 540
SEQIDNO_10  IH YMNETGASEEVAREHIKGIIEENWKILNQCCFDQSQFQEPFITFNLNSVRGSHFFYE 540
            ********************:**************************************

SEQIDNO_1   FGDGFGV DSWTKVDMKSVLIDPIPLGEE 569
SEQIDNO_10  FGDGFGV DSWTKVDMKSVLIDPIPLGEE 569
            **************************
```

Figure 3A

```
SEQIDNO_1    MDSSTATAMTAPFIDPTDHVNLKTDTDSSENRRMGNYKPSIWNYDFLQSLATHHNIVEER  60
SEQIDNO_12   MDSSTATAMTAPFIDPTDHVNLKTDTDSSENRRMGNYKPSIWNYDFLQSLATHHNIVEER  60
             *******************************************************

SEQIDNO_1    HLKLAEKLKGQVKFMFGAPMEPLAKLELVDVVQRLGLNHLFETEIKEALFSIYKDGSNGW  120
SEQIDNO_12   HLKLAEKLKGQVKFMFGAPMEPLAKLELVDVVQRLGLNHRFETEIKEALFSIYKDESNGW  120
             ***************************************  *************** ****

SEQIDNO_1    WFGHLHATSLRFRLLRQCGLFIPQDVFKTFQNKTGEFDMKLCDNVKGLLSLYEASYLGWK  180
SEQIDNO_12   WFGHLHATSLRFRLLRQCGLFIPQDVFKTFQNKTGEFDMKLCDNVKGLLSLYEASYLGWK  180
             ************************************************************

SEQIDNO_1    GENILDEAKAFTTKCLKSAWENISEKWLAKRVKHALALPLHWRVPRIEARWFIEAYEQEA  240
SEQIDNO_12   GENILDEAKAFATKYLKSAWENISEKWLAKRVKHALALPLHWRVPRIEARWFIEAYEQEA  240
             ***********:** *********************************************

SEQIDNO_1    NMNPTLLKLAKLDFNMVQSIHQKEIGELARWWVTTGLDKLASARNNLLQSYMWSCAIASD  300
SEQIDNO_12   NMNPTLLKLAKLDFNMVQSIHQKEIGELARWWVTTGLDKLASARNNLLQSYMWSCAIASD  300
             ************************************************************

SEQIDNO_1    PKFKLARETIVEIGSVLTVVDDGYDVYGSIDELDLYTSSVERWSSSEIDKLPNTLKLIFM  360
SEQIDNO_12   PKFKLARETIVEIGSVLTVVDDAYDVYGSMDELDLYTSSVERWSSSEIDKLPNTLKLIFM  360
             **********************.******:******************************

SEQIDNO_1    SMFNKTNEVGLRVQHERGYNSIPTFIKAWVEQCKSYQKEARWFHGGHTPPLEEYSLNGLV  420
SEQIDNO_12   SMFNKTNEVGLRVQHERGYNSIPTFIKAWVQQCKSYQKEARWFHGGHTPPLEEYSLNGLV  420
             *****************************:******************************

SEQIDNO_1    SIGFPLLLITGYVAIAENEAALDKVHPLPDLLHYSSLLSRLINDIGTSPDEMARGDNLKS  480
SEQIDNO_12   SIGFPLLLITGYVAIAENEAALDKVHPLPDLLHYSSLLSRLINDIGTSPDEMARGDNLKS  480
             ************************************************************

SEQIDNO_1    IHSYMNETGASEEVAREHIKGVIEENWKILNQCCFDQSQFQEPFITFNLNSVRGSHFFYE  540
SEQIDNO_12   IHSYMNGTGASEEVAREHIKGVIEENWKILNQCCFDQSQFQEPFITFNLNSVRGSHFFYE  540
             ****** *****************************************************

SEQIDNO_1    FGDGFGVSDSWTKVDMKSVLIDPIPLGEE  569
SEQIDNO_12   FGDGFGVSDSWTKVDMKSVLIDPIPLGEE  569
             *****************************
```

Figure 3B

```
SEQIDNO_1   MDSSTATAMTAPFIDPTDHVNLKTDTD SENRRMGNYKPSIWNYDFLQSLATHHNIVEER  60
SEQIDNO_14  MDSSTATAMTAPFIDPTDHVNLKTDTD SENRRMGNYKPSIWNYDFLQSLATHHNIVEER  60
            *************************** ***********************************

SEQIDNO_1   HLKLAEKLKGQVKFMFGAPMEPLAKLELVDVVQRLGLNHLFETEIKEALFSIYKDGSNGW  120
SEQIDNO_14  HLKLAEKLKGQVKFMFGAPMEPLAKLELVDVVQRLGLNHLFETEIKEVLFSIYKDGSNGW  120
            ***********************************************.************

SEQIDNO_1   WFGHLHATSLRFRLLRQCGLFIPQDVFKTFQNKTGEFDMKLCDNVKGLLSLYEASYLGWK  180
SEQIDNO_14  WFDHLHATSLRFRLLRQCGLFIPQDVFKMFQNKTGELDMKLCDNVKGLLSLYEASYLGWK  180
            **.************************* *******:***********************

SEQIDNO_1   GENILDEAKAFTTKCLKSAWENISEKWLAKRVKHALALPLHWRVPRIEARWFIEAYEQEA  240
SEQIDNO_14  GENILDEAKAFATKYLKSAWENISEKWLAKRVKHALALPLHWRVPRIEARWFIEAYEQEA  240
            ***********:** *********************************************

SEQIDNO_1   NMNPTLLKLAKLDFNMVQSIHQKEIGELARWWVTTGLDKLA ARNNLLQSYMWSCAIASD  300
SEQIDNO_14  NMNPTLLKLAKLDFNMVQSIHQKEIGELARWWVTTGLDKLA ARNNLLQSYMWSCAIASD  300
            ***************************************** ******************

SEQIDNO_1   PKFKLARETIVEIGSVLTVVDDGYDVYGSIDELDLYTSSVERWS EIDKLPNTLKLIFM  360
SEQIDNO_14  PKFKLARETIVEIGSVLTVVDDAYDVYGSMDELDLYTSSVERWS EIDKLPNTLKLIFM  360
            **********************.******:************** ***************

SEQIDNO_1   SMFNKTNEVGLRVQHERGYNSIPTFIKAWVEQCKSYQKEARWFHGGHTPPLEEYSLNGLV  420
SEQIDNO_14  SMFNKTNEVGLRVQHERGYNSIPTFIKAWVQQCKSYQKEARWFHGGHTPPLEEYSLNGLV  420
            *****************************:******************************

SEQIDNO_1   SIGFPLLLITGYVAIAENEAALDKVHPLPDLLHYSSLLSRLINDIGTSPDEMARGDNLKS  480
SEQIDNO_14  SIGFPLLLITGYVAIAENEAALDKVHPLPDLLHYSSLLSRLINDIGTSPDEMARGDNLKS  480
            ************************************************************

SEQIDNO_1   IH YMNETGASEEVAREHIKGVIEENWKILNQCCFDQSQFQEPFITFNLNSVRGSHFFYE  540
SEQIDNO_14  IH YMNETGASEEVAREHIKGVIEENWKILNQCCFDQSQFQEPFITFNLNSVRGSHFFYE  540
            ** *********************************************************

SEQIDNO_1   FGDGFGV DSWTKVDMKSVLIDPIPLGEE  569
SEQIDNO_14  FGDGFGV DSWTKVDMKSVLIDPIPLGEE  569
            ******* *********************
```

Figure 3C

MODIFIED SANTALENE SYNTHASE POLYPEPTIDES, ENCODING NUCLEIC ACID MOLECULES AND USES THEREOF

RELATED APPLICATIONS

Benefit of priority is claimed to U.S. Provisional Application No. 61/973,148, filed Mar. 31, 2014, entitled "MODIFIED SANTALENE SYNTHASE POLYPEPTIDES, ENCODING NUCLEIC ACID MOLECULES AND USES THEREOF," to Jean Davin Amick and Bryan N. Julien.

This application is related to International PCT Application Serial No., to Jean Davin Amick and Bryan N. Julien, filed the same day herewith, entitled "MODIFIED SANTALENE SYNTHASE POLYPEPTIDES, ENCODING NUCLEIC ACID MOLECULES AND USES THEREOF," which claims priority to U.S. Provisional Application Ser. No. 61/973,148.

The subject matter of each of the above-noted applications is incorporated by reference in its entirety.

INCORPORATION BY REFERENCE OF SEQUENCE LISTING PROVIDED ELECTRONICALLY

An electronic version of the Sequence Listing is filed herewith, the contents of which are incorporated by reference in their entirety. The electronic file was created on Mar. 30, 2015 is 935 kilobytes in size, and titled 239seq001.txt.

FIELD OF INVENTION

Provided are modified santalene synthase polypeptides, nucleic acid molecules encoding the modified santalene synthase polypeptides, and methods of using the modified santalene synthase polypeptides.

BACKGROUND

*Santalum* sp. santalene synthases are terpene synthases that catalyze the formation of santalenes and bergamotene, including α-santalene, β-santalene, α-exo-bergamotene and epi-β-santalene, from the acyclic pyrophosphate terpene precursor farnesyl diphosphate (FPP). These santalene and bergamotene sesquiterpenes can be converted chemically or biosynthetically to the sesquiterpene alcohols α-santalol, β-santalol, α-exo-bergamotol and epi-β-santalol. Santalols, bergamotol, santalenes and bergamotene are the main components of sandalwood oil, an important ingredient in the perfume industry for its soft, sweet-woody and animal-balsamic odor.

Historically, sandalwood oil has been obtained by distillation of the heartwood of *Santalum* species but centuries of over-exploitation has led to the demise of sandalwood in natural stands. Although large plantations are being established throughout northern Australia to satisfy demand and conserve remaining reserves, there is great variation in the amount of heartwood oil produced, even under near-identical growing conditions, due to genetic and environmental factors, such as climate and local conditions. Although chemical approaches to generate santalols and the other sesquiterpenoids in sandalwood oil have been attempted, the highly complex structures of these compounds have rendered economically viable synthetic processes for their preparation in large quantities unattainable. Thus, there is a need for efficient, cost-effective syntheses of santalols and other sesquiterpenoids that impart the highly sought after sandalwood fragrance for use in the fragrance industry.

Thus, among the objects herein, is the provision of modified santalene synthases and methods of using the modified santalene synthase for the production of santalenes, bergamotene, santalols and bergamotol.

SUMMARY

Provided are nucleic acid molecules encoding modified santalene synthase polypeptides, including catalytically active fragments of the synthase polypeptides that include the modifications. The encoded modified polypeptides also are provided, as are host cells, that contain the nucleic acid molecules and/or polypeptides, where the nucleic acid molecules and encoded polypeptides are heterologous to the cells. If the cells are human cells, they are isolated or are a cell culture. The synthase polypeptides include catalytically active fragments that catalyze production of a terpene(s) from an acyclic pyrophosphate terpene precursor, such as FPP.

Methods for producing terpene products are provided. The terpene products can be produced in vivo, such as in host cells, or in vitro. In vivo production can be effected, for example, by culturing the cells under conditions such that the encoded heterologous synthase is expressed and catalyzes production of a terpene product or products. Methods for producing the encoded synthases by culturing the cells also are provided. Among the encoded modified synthase polypeptides are those that catalyze increased production total terpenes, increased santalene and/or an altered product profile. The encoded modified santalene synthase polypeptide does not contain the sequence of amino acids set forth in any of SEQ ID NOS: 1, 10, 12, 14, 27-43 or 258.

All nucleic acid molecules can be cDNA and can be isolated or provided in a cell, particularly a cell, such as yeast cell, in which the encoded synthase is heterologous. The modifications described herein are with reference to *Santalum* album santalene synthase (SaSSy) whose sequence is set forth in SEQ ID NO:1. Also included are modified variants of other *Santalum* species, such as modified variants of a santalene synthase whose sequence is set forth in any of SEQ ID NOS: 10, 12, 14, 27-43 or 258, where the modifications are identified by alignment of the unmodified polypeptide with SEQ ID NO:1 (See FIGS. 2A-F and FIGS. 3A-C). For each nucleic acid molecule described herein, the encoded synthase polypeptide is provided as host cells containing each nucleic acid molecule and each encoded synthase polypeptide. Host cells include any suitable cell for expression of the encoded polypeptides, including, but not limited to, yeast and plant cells. If the cells are human cells, they are isolated or cultured.

In general, the nucleic acid molecules encode molecules that exhibit at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more sequence identity to the polypeptide of SEQ ID NO:1, which sets forth the sequence of a synthase isolated from Santalene Album (see, U.S. Pat. No. 8,569,025). In some embodiments, the modified polypeptides have at least 80% sequence identity with the polypeptide of SEQ ID NO:1, and in general up to 85% sequence identity. In other embodiments the modified encoded synthase has at least 75% sequence identity and less than 94% sequence identity, such as between 80% and less than 94%, between 85% and less than 94%, particularly less than 94%. For example, the nucleic acid molecules encode a synthase with a sequence of amino acids selected from among less than 94% and more than 80%; less than 93% and more than 80%; less than 92% and more than 80%; less than 95% and more than 82%; less than 94% and more than 82%; less than 93% and more than 82%; less than 92% and more than 82%; less than 95% and more than 85%; less than 94% and more than 85%; less than 93% and more than 85%; and less than 92% and more than 85% sequence identity to SEQ ID NO:1 as determined by alignment. In other embodiments that modified synthase contains only or at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119 or 120 modifications, such as least 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119 or 120. Modifications include amino acid replacements, insertions and deletions.

Among the provided nucleic acid molecules are those encoding a modified santalene synthase polypeptide that catalyzes production of increased amount of a terpene product(s). These nucleic acid molecules encode a modified santalene synthase polypeptide containing an amino acid modification(s) in an unmodified santalene synthase polypeptide having the sequence of amino acids set forth in SEQ ID NO:1, or in a catalytically active fragment thereof that contains the modifications; the amino acid modification(s) are selected from among amino acid replacement(s), deletion(s) and insertion(s); the encoded modified santalene synthase polypeptide exhibits at least 75% sequence identity to the santalene synthase set forth in SEQ ID NO:1; the modified santalene synthase catalyzes the production of total terpene product(s) from farnesyl diphosphate (FPP) in a host cell in an amount that is greater than the amount of the same total terpene products produced from FPP by the santalene synthase encoded by the sequence of nucleotides set forth in SEQ ID NO:3 in the same host cell and under the same conditions; the host cell is a cell that produces FPP; and the terpene product or product is a sesquiterpene, such as, but not limited to one or more of α-santalene, α-exo-bergamotene, epi-β-santalene, β-santalene, or stereoisomers and mixtures thereof. Exemplary of encoded modified santalene synthases are those that catalyze increased amounts of total terpene products produced from FPP compared to the total terpene products produced from FPP by the santalene synthase encoded by the sequence of nucleotides set forth in SEQ ID NO:3. In particular, the amount of increase is more than 100%, such as, at least 103%, such as 105% to 500%, 110% to 250%, 125% to 500%, 125% to 250%, 130% to 500%, 130% to 250%, 150% to 500%, or 150% to 250%.

Exemplary of these nucleic acid molecules are those that encode a modified santalene synthase polypeptide containing an amino acid replacement corresponding to replacement at a position selected from among positions 28, 31, 56, 64, 73, 110, 117, 170, 183, 206, 213, 342, 342, 345, 346, 363, 379, 381, 385, 405, 408, 436, 452, 480, 487, 518 and 548, with reference to SEQ ID NO:1. Corresponding positions are identified by alignment of the unmodified santalene synthase polypeptide with the polypeptide set forth in SEQ ID NO:1. Particular replacements do not correspond to A28S, N31S, K73M, I112V, V346T, E487G or E487Q, with reference to SEQ ID NO:1.

Among the nucleic acid molecules that encode synthase polypeptides that catalyze the increased amounts of terpene, such as santalene, are any of the above that contain an amino acid replacement(s) selected from among amino acid replacement(s) corresponding to A28G, N31A, I56K, L64E, L64Q, K73E, F110L, I112N, I112Q, S117E, S117D, S117N, S170A, N183E, N183K, N183D, K206G, K206Q, K206A, K206S, K206T, K213R, R342H, R342G, R342S, R342Q, C345L, C345P, C345T, V346A, F363Y, Y379I, S381P, F385L, G405S, T408A, A436C, L452I, S480A, E487S, S518E, T548A, T548S, or conservative replacement(s) thereof, with reference to amino acid positions set forth in SEQ ID NO:1, or the same replacement(s) at a corresponding amino acid residue in the unmodified santalene synthase polypeptide.

Any of the nucleic acid molecules encoding modified santalene synthase polypeptides that catalyze increased production of terpene products can include modifications corresponding to substitution of one or more domains or contiguous portions thereof, containing at least 3, 4, 5, 6, 7, 8, 9, 10, 15 or more amino acids, of the unmodified santalene synthase polypeptide with the corresponding heterologous domain or contiguous portion thereof, containing at least 3, 4, 5, 6, 7, 8, 9, 10, 15 or more amino acids, from a different terpene synthase (i.e. domain swap). In particular, such nucleic acid molecules that contain one or more heterologous domains (i.e. domain swaps) include those encoding a modified santalene synthase polypeptide containing an amino acid replacement(s) selected from among amino acid replacement(s) corresponding to A28G, N31A, I56K, L64E, L64Q, K73E, F110L, I112N, I112Q, S117E, S117D, S117N, S170A, N183E, N183K, N183D, K206G, K206Q, K206A, K206S, K206T, K213R, R342H, R342G, R342S, R342Q, C345L, C345P, C345T, V346A, F363Y, Y379I, S381P, F385L, G405S, T408A, A436C, L452I, S480A, E487S, S518E, T548A, T548S, or conservative replacement(s) thereof, with reference to amino acid positions set forth in SEQ ID NO:1, or the same replacement(s) at a corresponding amino acid residue in the unmodified santalene synthase polypeptide.

The nucleic acid molecules encoding a modified santalene synthase with modified domains include those in which the domain that is modified is selected from among unstructured loop 1, alpha helix 1, unstructured loop 2, alpha helix 2, unstructured loop 3, alpha helix 3, unstructured loop 4, alpha helix 4, unstructured loop 5, alpha helix 5, unstructured loop 6, beta strand 1, unstructured loop 7, beta strand 2, unstructured loop 8, alpha helix 6, unstructured loop 9, alpha helix 7, unstructured loop 10, alpha helix 8, unstructured loop 11, alpha helix 9, unstructured loop 12, alpha helix 10, unstructured loop 13, alpha helix A, alpha helix C, unstructured loop 15, alpha helix D, unstructured loop 16, alpha helix D1, unstructured loop 17, alpha helix D2, alpha helix E, unstructured loop 18, alpha helix F, unstructured loop 19, alpha helix G1, alpha helix G2, unstructured loop 20, alpha helix H1, alpha helix H2, unstructured loop 21, alpha helix α1, unstructured loop 22, alpha helix I, unstructured loop 23, alpha helix J, unstructured loop 24, alpha helix K and unstructured loop 25.

The substituting domain can be from any different terpene synthase, such as a diterpene or sesquiterpene synthase. Exemplary of such other different terpene synthases is a synthase selected from *Hyoscyamus muticus* Vestipiradiene synthase set forth in SEQ ID NO:276, (+)-Bornyl diphosphate synthase (BDS) set forth in SEQ ID NO:268, citrus valencene synthase (CVS) set forth in SEQ ID NO:293, *Vitis vinifera* valencene synthase (Vv CVS) set forth in SEQ ID NOS:270, bergamotene synthase (BS) set forth in SEQ ID NO:271, *Nicotiana tabacum* 5-epi-aristolochene synthase (TEAS) set forth in SEQ ID NO:273, germacrene A set forth in SEQ ID NO:274, amorpha-4,11-diene synthase (ADS) set forth in SEQ ID NO:275, or *Hyoscyamus muticus* premnaspirodiene synthase (HPS) set forth in SEQ ID NO:272, or a modified variant thereof that exhibits at least 80% sequence identity to any of SEQ ID NOS: 268, 270-274, 276 or 293 and exhibits activity to catalyze production of a terpene product from an acyclic pyrophosphate terpene precursor of the respective terpene synthase set forth in any of SEQ ID NOS: 268, 270-274, 276 or 293.

Thus, included among the encoded synthase polypeptides are those that contain a heterologous alpha helix 2 domain or a contiguous portion thereof, containing at least 3, 4, 5, 6, 7, 8, 9, 10, 15 or more amino acids, and an unstructured loop 3 or contiguous portion thereof, whereby amino acid residues corresponding to amino acid residues 73-79 of the santalene synthase polypeptide set forth in SEQ ID NO:1 are substituted with all or a portion of the corresponding region from a different terpene synthase. For example, molecules in which the different terpene synthase from which the domain is derived is from BDS and has the sequence set forth in SEQ ID NO:268 or a modified variant thereof that exhibits at least 80% sequence identity to SEQ ID NO:268 and exhibits activity to catalyze production of a terpene product from an acyclic pyrophosphate terpene precursor of the respective terpene synthase set forth in SEQ ID NO: 268. For example, among nucleic acid molecules that encode a modified santalene synthase that provides increased amounts of terpenes are those that contain a heterologous alpha helix 2 domain or a contiguous portion thereof containing at least 5, 6, 7, 8, 9, 10, 15 or more amino acids, and an unstructured loop 3 or contiguous portion thereof containing at least 5, 6, 7, 8, 9, 10, 15 or more amino acids, and where amino acid residues corresponding to amino acid residues 73-79 of the santalene synthase polypeptide set forth in SEQ ID NO:1 are substituted with amino acids RILLKEK (SEQ ID NO:203).

In another embodiment, the nucleic acid molecule encodes a modified santalene synthase polypeptide containing a heterologous unstructured loop 4 or a contiguous portion thereof, containing at least 4, 5, 6, 7, 8, 9, 10, 15 or more amino acids, whereby amino acid residues corresponding to amino acid residues 97-100 of the santalene synthase polypeptide set forth in SEQ ID NO:1 are substituted with all or a portion of the corresponding region from a different terpene synthase. For example, nucleic acid molecules that encode a synthase that catalyzes production of increased amounts of terpenes can include a heterologous domain or portion thereof from CVS, whose sequence is set forth in SEQ ID NO:270 or a modified variant thereof that exhibits at least 80% sequence identity to SEQ ID NO:270 and exhibits activity to catalyze production of a terpene product from an acyclic pyrophosphate terpene precursor of the respective terpene synthase set forth in SEQ ID NO: 270; or the different terpene synthase is the modified variant designated CVS V19 whose sequence is set forth in SEQ ID NO:269. The encoded modified santalene synthase polypeptide contains a heterologous unstructured loop 4 or a contiguous portion thereof, containing at least 4, 5, 6, 7, 8, 9, 10, 15 or more amino acids, whereby amino acid residues corresponding to amino acid residues 97-100 of the santalene synthase polypeptide set forth in SEQ ID NO:1 are substituted with amino acids VAYH (SEQ ID NO:205).

In other embodiments of the nucleic acid molecules are those in which the encoded synthase polypeptide contains a heterologous alpha helix 4 or a contiguous portion thereof, containing at least 5, 6, 7, 8, 9, 10, 15 or more amino acids, whereby amino acid residues corresponding to amino acid residues 103-115 of the santalene synthase polypeptide set forth in SEQ ID NO:1 are substituted with all or a portion, containing at least 5, 6, 7, 8, 9, 10, 15 or more amino acids, of the corresponding region from a different terpene synthase. In others of these embodiments, the different terpene synthase is CVS set forth in SEQ ID NO:270 or a modified variant thereof that exhibits at least 80% sequence identity to SEQ ID NO:270 and exhibits activity to catalyze production of a terpene product from an acyclic pyrophosphate terpene precursor of the respective terpene synthase set forth in SEQ ID NO: 270; or the different terpene synthase is the modified variant designated CVS V19 whose sequence is set forth in SEQ ID NO:269. In others of these embodiments, the encoded modified santalene synthase polypeptide comprises a heterologous alpha helix 4 or a contiguous portion thereof, whereby amino acid residues corresponding to amino acid residues 103-115 of the santalene synthase polypeptide set forth in SEQ ID NO:1 are substituted with amino acid residues KEIEDAIQQLCPI (SEQ ID NO:206).

In others of these embodiments the encoded modified santalene synthase polypeptide comprises a contiguous sequence of amino acids corresponding to heterologous domains from two or more adjacent domains, or contiguous portions thereof, selected from among heterologous unstructured loop 6 or a contiguous portion thereof, beta strand 1 or a contiguous portion thereof, unstructured loop 7 or a contiguous portion thereof, beta strand 2 or a contiguous portion thereof, unstructured loop 8 or a contiguous portion thereof, alpha helix 6 or a contiguous portion thereof, unstructured loop 9 or a contiguous portion thereof, and alpha helix 7 or a contiguous portion thereof, where the contiguous portion contains at least 4, 5, 6, 7, 8, 9, 10, 15 or more amino acids. In others of these embodiments, the nucleic acid molecule encodes a modified santalene synthase that contains adjacent heterologous domains or contiguous portions, containing at least 4, 5, 6, 7, 8, 9, 10, 15 or more amino acids, thereof from a different terpene synthase, whereby amino acid residues corresponding to amino acid residues 138-168 of the santalene synthase polypeptide set forth in SEQ ID NO:1 are substituted with all or a portion, containing at least 4, 5, 6, 7, 8, 9, 10, 15 or more amino acids, of the corresponding domain or portion thereof from a different terpene synthase. For example, the different terpene synthase is CVS, whose sequence is set forth in SEQ ID NO:270 or a modified variant thereof that exhibits at least 80% sequence identity to SEQ ID NO:270 and exhibits activity to catalyze production of a terpene product from an acyclic pyrophosphate terpene precursor of the respective terpene synthase set forth in SEQ ID NO: 270; or the different terpene synthase is the modified variant designated CVS V19 whose sequence is set forth in SEQ ID NO:269. As an example, the nucleic acid molecule encodes a modified santalene synthase polypeptide that contains heterologous domains or contiguous portions thereof, containing at least 4, 6, 7, 8, 9, 10, 15 or more amino acids, from a different terpene synthase, whereby amino acid residues corresponding to amino acid residues 138-168 of the santalene synthase polypeptide set forth in SEQ ID NO:1 are substituted with amino acid residues QGIKISCD-VFEQFKDDEGRFKSSLINDVQGM (SEQ ID NO:211) or QGIKISCDVFEQFKDDEDRFKSSLINDIQGM (SEQ ID NO:212).

In another example of nucleic acid molecules that encode modified terpene synthases that catalyze increased terpene production as described above, the nucleic acid molecule encodes a modified santalene synthase polypeptide that contains a heterologous unstructured loop 6 or a contiguous portion thereof, containing at least 4, 5, 6, 7, 8, 9, 10, 15 or more amino acids, whereby amino acid residues corresponding to amino acid residues 116-124 of the santalene synthase set forth in SEQ ID NO:1 are substituted with the corresponding residues from a different terpene synthase. As an example, the different terpene synthase is CVS set forth in SEQ ID NO:270 or a modified variant thereof that exhibits at least 80% sequence identity to SEQ ID NO:270 and exhibits activity to catalyze production of a terpene product from an acyclic pyrophosphate terpene precursor of the respective terpene synthase whose sequence is set forth in SEQ ID NO: 270; or the different terpene synthase is the modified variant designated CVS V19 whose sequence is set forth in SEQ ID NO:269. For example, the nucleic acid molecule encodes a modified santalene synthase polypeptide that encodes a heterologous unstructured loop 6 or a contiguous portion thereof, containing at least 4, 5, 6, 7, 8, 9, 10, 15 or more amino acids, whereby amino acid residues corresponding to amino acid residues 116-124 of the santalene synthase polypeptide set forth in SEQ ID NO:1 are substituted with amino acid residues HIDSDKAD (SEQ ID NO:207).

Exemplary of the nucleic acid molecules that encode modified terpene synthases that catalyze increased terpene production as described above, are nucleic acid molecules that contain the nucleic acid sequence set forth in any of SEQ ID NOS: 45, 47, 50-53, 55-58, 62-64, 67, 68, 70, 81-86, 88-100, 102-119, 121-130, 219, 220, 222-232, 235-238, 240-242, 262, 264, 265, 278-282, 287, 304 and 306-308 or a sequence that exhibits at least 85%, 86%, 87%, 88%, 89%, 90%, 91%, 92%, 93%, 94%, 95%, 96%, 97%, 98%, 99% or more sequence identity to any of SEQ ID NOS: 45, 47, 50-53, 55-58, 62-64, 67, 68, 70, 81-86, 88-100, 102-119, 121-130, 219, 220, 222-232, 235-238, 240-242, 262, 264, 265, 278-282, 287, 304 and 306-308 and that encodes a modified santalene synthase polypeptide that contains the amino acid modification(s). In particular, provided are nucleic acid molecules that contain the sequence of nucleotides set forth in any of SEQ ID NOS: 45, 47, 50-53, 55-58, 62-64, 67, 68, 70, 81-86, 88-100, 102-119, 121-130, 219, 220, 222-232, 235-238, 240-242, 262, 264, 265, 278-282, 287, 304 and 306-308.

Provided are nucleic acid molecules where the encoded modified santalene synthase comprises the sequence of amino acids set forth in any of SEQ ID NOS: 131, 133, 136-138, 140-142, 146, 147, 148, 151, 152, 154, 164, 165, 166, 168-172, 174, 175, 177-179, 182-190, 192-196, 233, 243-257, 259-261, 266, 277, 283, 285, 286, 288 and 309-311, or a sequence of amino acids that exhibits at least 85%, 86%, 87%, 88%, 89%, 90%, 91%, 92%, 93%, 94%, 95%, 96%, 97%, 98%, 99% or more sequence identity to any of SEQ ID NOS: 131, 133, 136-138, 140-142, 146, 147, 148, 151, 152, 154, 164, 165, 166, 168-172, 174, 175, 177-179, 182-190, 192-196, 233, 243-257, 259-261, 266, 277, 283, 285, 286, 288 and 309-311 and that contains the amino acid modification(s), such as, but not limited to, nucleic acid molecules where the encoded modified santalene synthase comprises the sequence of amino acids set forth in any of SEQ ID NOS: 131, 133, 136-138, 140-142, 146, 147, 148, 151, 152, 154, 164, 165, 166, 168-172, 174, 175, 177-179, 182-190, 192-196, 233, 243-257, 259-261, 266, 277, 283, 285, 286 and 288.

Also provided are nucleic acid molecules that encode modified santalene synthases that catalyze production of terpenes with a different profile of terpene products from the products catalyzed by the synthase encoded by the nucleic acid molecule whose sequence is set forth in SEQ ID NO: 3. These modifications can be combined with the above-discussed modifications to produce synthases that catalyze increased production of terpene products and also an altered profile. The following discussion provides nucleic acid molecules that encode a synthase polypeptide that catalyzes production of an altered profile. The altered profile can be that expressed in a yeast host cell, particularly the yeast host cells described herein.

Provided are nucleic acid molecules that encode a modified santalene synthase polypeptide that catalyzes production of terpenes with an altered terpene profile compared with the unmodified polypeptide. In particular, the encoded modified santalene synthase polypeptide contains an amino acid modification(s) in the unmodified santalene synthase polypeptide containing the sequence of amino acids set forth in SEQ ID NO:1 or in a catalytically active fragment thereof, where: the amino acid modification(s) are selected from among amino acid replacement(s), deletion(s) and insertion(s); the modified santalene synthase polypeptide exhibits at least 75% sequence identity to the santalene synthase set forth in SEQ ID NO:1; the modified santalene synthase polypeptide does not contain the sequence of amino acids set forth in any of SEQ ID NOS: 10, 12, 14, 27-43 or 258; and the modified santalene synthase catalyzes the production of terpene products from farnesyl diphosphate (FPP) in a host cell with an altered product profile compared to the profile of the terpene products produced from FPP by the santalene synthase encoded by the sequence of nucleotides set forth in SEQ ID NO:3 in the same host cell and under the same conditions. The host cell is a cell that produces FPP (natively or modified to produce FPP); and the terpene product or products is a sesquiterpene. Such host cells can be, for example, a yeast host modified to produce FPP. The terpene produced in the profile can include one or more of α-santalene, α-exo-bergamotene, epi-β-santalene, β-santalene, or stereoisomers or mixtures thereof. The profile is altered in that the amount of at least one terpene product is different from that produced by unmodified synthase encoded by the sequence of nucleotides set forth in SEQ ID NO:3. For example, production of at least one terpene product is increased or decreased in the product profile by at least 1%, 2%, 3%, 4%, 5%, 6%, 7%, 8%, 9%, 10%, 15%, 20%, 25%, 30%, 35%, 40%, 50%, 60%, 70%, 80%, 90% or more compared to the santalene synthase encoded by the sequence of nucleotides set forth in SEQ ID NO:3.

The encoded modified santalene synthase polypeptide exhibits at least 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more sequence identity to the santalene synthase set forth in SEQ ID NO:1, such as, for example, at least 80% sequence identity to the santalene synthase set forth in SEQ ID NO:1. The encoded modified santalene synthase polypeptide, compared to the unmodified santalene synthase not containing the modifications or the santalene synthase polypeptide set forth in SEQ ID NO:1, contains at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119 or 120 modifications in sequence, such as by insertion and/or deletions of amino acid residues, such at least 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119 or 120 amino acid modifications; or the modified santalene synthase polypeptide comprises a sequence of amino acids that has less than 94% or 95% sequence identity to the santalene synthase set forth in SEQ ID NO:1 and more than 75% sequence identity to the santalene synthase set forth in SEQ ID NO:1, but, as noted above, does not contain the sequence of amino acids set forth in any of SEQ ID NOS: 1, 10, 12, 14, 27-43 or 258.

Exemplary are nucleic acid molecules in which the encoded modified santalene synthase polypeptide contains a sequence of amino acids that has a sequence identity to the santalene synthase set forth in SEQ ID NO:1 that is selected from among less than 94% and more than 80%; less than 93% and more than 80%; less than 92% and more than 80%; less than 95% and more than 82%; less than 94% and more than 82%; less than 93% and more than 82%; less than 92% and more than 82%; less than 95% and more than 85%; less than 94% and more than 85%; less than 93% and more than 85%; and less than 92% and more than 85%. These include nucleic acid molecules where the resulting modifications in the encoded polypeptide include amino acid replacement(s), where: the modified santalene synthase polypeptide comprises an amino acid replacement corresponding to replacement at a position selected from among position 9, 18, 24, 26, 28, 198, 205, 282, 313, 329, 335, 338, 345, 346, 381, 385, 395, 403, 404, 483 and 548, with reference to SEQ ID NO:1; and corresponding positions are identified by alignment of the unmodified santalene synthase polypeptide with the polypeptide set forth in SEQ ID NO:1. In general, the replacement does not correspond to A28S or V346T, with reference to SEQ ID NO:1. Exemplary of these nucleic acid molecules are those where the encoded modified santalene synthase polypeptide contains an amino acid replacement(s) selected from among amino acid replacement(s) corresponding to M9T, M9V, D18N, T24I, T26N, A28S, A28G, S198N, E205Q, F282W, I313L, S329F, L335H, S338Y, C345L, C345P, V346A, S381G, S381P, F385L, S395A, F403Y, H404Y, C483R, T548A and T548S, or conservative replacement(s) thereof, with reference to amino acid positions set forth in SEQ ID NO:1, particularly where the modified santalene synthase polypeptide comprises an amino acid replacement(s) selected from among amino acid replacement(s) corresponding to A28G, F282W, I313L, S329F, C345L, C345P, V346A, S381P, F385L, C483R, T548A and T548S, or conservative replacement(s) thereof, with reference to amino acid positions set forth in SEQ ID NO:1. Provided are nucleic acid molecules and the encoded synthases that comprise the amino acid mutation corresponding to F282W. Combining it with other mutations at a position corresponding to K206, such as K206S, K206T, or K206G and/or mutations at a position corresponding to N183 alters the product profile, particularly by increasing santalenes, and increases total terpene production.

Among the nucleic acids are nucleic acid molecules that encode modified santalene synthase polypeptides that catalyze production of terpenes with an altered terpene profile are those that contain modifications corresponding to substitution of one or more domains or contiguous portions thereof, containing at least 3, 4, 5, 6, 7, 8, 9, 10, 15 or more amino acids, of the unmodified santalene synthase polypeptide with the corresponding heterologous domain or contiguous portion thereof, containing at least 3, 4, 5, 6, 7, 8, 9, 10, 15 or more amino acids, from a different terpene synthase.

Among the nucleic acid molecules are those that encode modified santalene synthase polypeptides that contain an amino acid replacement(s) selected from among amino acid replacement(s) corresponding to M9T, D18N, T24I, T26N, A28G, S198N, E205Q, F282W, I313L, S329F, L335H, S338Y, C345L, C345P, V346A, S381G, S381P, F385L, S395A, F403Y, H404Y, C483R, T548A and T548S, or conservative replacement(s) thereof, with reference to amino acid positions set forth in SEQ ID NO:1, or the same replacement(s) at a corresponding amino acid residue in the unmodified santalene synthase polypeptide; and contain modifications corresponding to substitution of one or more domains or contiguous portions thereof, containing at least 3, 4, 5, 6, 7, 8, 9, 10, 15 or more amino acids, of the unmodified santalene synthase polypeptide with the corresponding heterologous domain or contiguous portion thereof, containing at least 3, 4, 5, 6, 7, 8, 9, 10, 15 or more amino acids, from a different terpene synthase.

Replaced domains and contiguous portions include domains selected from among unstructured loop 1, alpha helix 1, unstructured loop 2, alpha helix 2, unstructured loop 3, alpha helix 3, unstructured loop 4, alpha helix 4, unstructured loop 5, alpha helix 5, unstructured loop 6, beta strand 1, unstructured loop 7, beta strand 2, unstructured loop 8, alpha helix 6, unstructured loop 9, alpha helix 7, unstructured loop 10, alpha helix 8, unstructured loop 11, alpha helix 9, unstructured loop 12, alpha helix 10, unstructured loop 13, alpha helix A, alpha helix C, unstructured loop 15, alpha helix D, unstructured loop 16, alpha helix D1, unstructured loop 17, alpha helix D2, alpha helix E, unstructured loop 18, alpha helix F, unstructured loop 19, alpha helix G1, alpha helix G2, unstructured loop 20, alpha helix H1, alpha helix H2, unstructured loop 21, alpha helix α1, unstructured loop 22, alpha helix I, unstructured loop 23, alpha helix J, unstructured loop 24, alpha helix K and unstructured loop 25.

For these nucleic acid molecules the different terpene synthase can be a sesquiterpene synthase. Exemplary thereof is a different terpene synthase selected from *Hyoscyamus muticus* Vestipiradiene synthase (HVS) set forth in SEQ ID NO:276, (+)-Bornyl diphosphate synthase (BDS) set forth in SEQ ID NO:268, citrus valencene synthase (CVS) set forth in SEQ ID NO:293, *Vitis vinifera* valencene synthase (Vv CVS) set forth in SEQ ID NOS:270, bergamotene synthase (BS) set forth in SEQ ID NO:271, *Nicotiana tabacum* 5-epi-aristolochene synthase (TEAS) set forth in SEQ ID NO:273, germacrene A set forth in SEQ ID NO:274, amorpha-4,11-diene synthase (ADS) set forth in SEQ ID NO:275, or *Hyoscyamus muticus* premnaspirodiene synthase (HPS) set forth in SEQ ID NO:272, or a modified variant thereof that exhibits at least 80% sequence identity to any of SEQ ID NOS: 268, 270-274, 276 or 293 and exhibits activity to catalyze production of a terpene product from an acyclic pyrophosphate terpene precursor of the respective terpene synthase set forth in any of SEQ ID NOS: 268, 270-274, 276 or 293. The resulting nucleic acid molecules include those in which the encoded modified variant exhibits at least 81%, 82%, 83%, 84%, 85%, 86%, 87%, 88%, 89%, 90%, 91%, 92%, 93%, 94%, 95%, 96%, 97%, 98%, 99% or more sequence identity to any of SEQ ID NOS: 268, 270-274, 276 or 293. The other different terpene can be a modified citrus valencene synthase designated CVS V19 set forth in SEQ ID NO: 269.

The nucleic acid molecule can encode a modified santalene synthase that includes a heterologous unstructured loop 1 domain or a contiguous portion thereof, whereby amino acid residues corresponding to amino acids 1-31 of the santalene synthase polypeptide set forth in SEQ ID NO:1 are substituted with all or a portion of the corresponding region from a different terpene synthase, such as, but not limited to, where the different terpene synthase is HVS set forth in SEQ ID NO:276 or a modified variant thereof that exhibits at least 80% sequence identity to SEQ ID NO:276 and exhibits activity to catalyze production of a terpene product from an acyclic pyrophosphate terpene precursor of the respective terpene synthase set forth in SEQ ID NO: 276. The modified nucleic acid molecules encoding a synthase that catalyzes production of terpenes with an altered terpene profile include those described herein, including those in which the modified santalene synthase comprises a heterologous unstructured loop 1 domain or a contiguous portion thereof, whereby amino acid residues corresponding to amino acid residues 1-31 of the santalene synthase set forth in SEQ ID NO:1 are substituted with amino acids MAPAIVMSNY-EEEEIV (SEQ ID NO:202).

The nucleic acid molecule can encode a modified santalene synthase that includes a heterologous unstructured loop 4 or a contiguous portion thereof, whereby amino acid residues corresponding to amino acid residues 97-100 of the santalene synthase polypeptide set forth in SEQ ID NO:1 are substituted with all or a portion of the corresponding region from a different terpene synthase, including where the different terpene synthase is CVS set forth in SEQ ID NO:270 or a modified variant thereof that exhibits at least 80% sequence identity to SEQ ID NO:270 and exhibits activity to catalyze production of a terpene product from an acyclic pyrophosphate terpene precursor of the respective terpene synthase set forth in SEQ ID NO: 270; or the different terpene synthase is the modified variant designated CVS V19 set forth in SEQ ID NO:269. Also included are nucleic acids encoding the modified santalene synthase polypeptides that catalyze production of terpenes with an altered terpene profile and that contain a heterologous domain or contiguous portion from a different synthase, such as a heterologous unstructured loop 4 or a contiguous portion thereof, whereby amino acid residues corresponding to amino acid residues 97-100 of the santalene synthase polypeptide set forth in SEQ ID NO:1 are substituted with amino acids VAYH (SEQ ID NO:205).

In other embodiments of the nucleic acid molecules encoding a modified santalene synthase with an altered profile, the nucleic acid molecule can encode a modified santalene synthase that includes or a heterologous alpha helix 4 or a contiguous portion thereof, whereby amino acid residues corresponding to amino acid residues 103-115 of the santalene synthase polypeptide set forth in SEQ ID NO:1 are substituted with all or a portion of the corresponding region from a different terpene synthase. For the nucleic acid molecules encoding a modified synthase with a portion from a different synthase, the different terpene synthase can be the CVS whose sequence is set forth in SEQ ID NO:270 or a modified variant thereof that exhibits at least 80% sequence identity to SEQ ID NO:270 and exhibits activity to catalyze production of a terpene product from an acyclic pyrophosphate terpene precursor of the respective terpene synthase whose sequence is set forth in SEQ ID NO: 270; or a different terpene synthase that is the modified variant designated CVS V19 whose sequence is set forth in SEQ ID NO:269. The nucleic acid can encode a modified santalene synthase polypeptide that contains a heterologous alpha helix 4 or a contiguous portion thereof, whereby amino acid residues corresponding to amino acid residues 103-115 of the santalene synthase polypeptide set forth in SEQ ID NO:1 are substituted with amino acid residues KEIEDAIQQLCPI (SEQ ID NO:206).

In other embodiments of the nucleic acid molecules encoding a modified santalene synthase with an altered profile, the nucleic acid molecule can encode a modified santalene synthase polypeptide that contains a contiguous sequence of amino acids corresponding to heterologous domains from two or more adjacent domains, or contiguous portions thereof, selected from among heterologous unstructured loop 6 or a contiguous portion thereof, beta strand 1 or a contiguous portion thereof, unstructured loop 7 or a contiguous portion thereof, beta strand 2 or a contiguous portion thereof, unstructured loop 8 or a contiguous portion thereof, alpha helix 6 or a contiguous portion thereof, unstructured loop 9 or a contiguous portion thereof, and alpha helix 7 or a contiguous portion thereof. Exemplary encoded modified synthases are those that contain adjacent heterologous domains or contiguous portions thereof from a different terpene synthase, whereby amino acid residues corresponding to amino acid residues 138-168 or 138-166 of the santalene synthase polypeptide set forth in SEQ ID NO:1 are substituted with all or a portion of the corresponding domain or portion thereof from a different terpene synthase. For example, among exemplary nucleic acid molecules include those that encode a modified santalene synthase polypeptide that contain adjacent heterologous domains or contiguous portions thereof from a different terpene synthase, whereby amino acid residues corresponding to amino acid residues 138-168 or 138-166 of the santalene synthase polypeptide set forth in SEQ ID NO:1 are substituted with amino acid residues HGHHVPQEAFCSFMDDVRN-FRAWLCEDVR (SEQ ID NO:210) or HGH-HVPQEVFCSFMDDVGNFRAWLCEDVR (SEQ ID NO:215).

In other embodiments of the nucleic acid molecules encoding a modified santalene synthase with an altered profile, the modified santalene synthase polypeptide comprises a heterologous unstructured loop 6 or a contiguous portion thereof, whereby amino acid residues corresponding to amino acid residues 116-124 of the santalene synthase set forth in SEQ ID NO:1 are substituted with the corresponding residues of a different terpene synthase. The different terpene synthase can be CVS whose sequence is set forth in SEQ ID NO:270 or a modified variant thereof that exhibits at least 80% sequence identity to SEQ ID NO:270 and exhibits activity to catalyze production of a terpene product from an acyclic pyrophosphate terpene precursor of the respective terpene synthase set forth in SEQ ID NO: 270; or the different terpene synthase is the modified variant designated CVS V19 whose sequence is set forth in SEQ ID NO:269. Among such nucleic acid molecules include those that encode a modified santalene synthase polypeptide that contains a heterologous unstructured loop 6 or a contiguous portion thereof, whereby amino acid residues corresponding to amino acid residues 116-124 of the santalene synthase polypeptide set forth in SEQ ID NO:1 are substituted with amino acid residues HIDSDKAD (SEQ ID NO:207). Among the nucleic acid molecules are those that encode santalene syntases that include the mutations at K206, N183 and F282, such as K206A or S/N183Dor K/F282W.

For all of the nucleic acid molecules provided herein, and in particular nucleic acid molecules encoding a modified santalene synthase that produces an altered product profile, additional modification or modifications include deletion of one or more amino acid residues so that the modified santalene synthase polypeptide contains a deletion of one or more contiguous amino acid residues from the N-terminus and/or C-terminus of the unmodified santalene synthase polypeptide. Such a molecule is not a molecule that only contains such deletion and is specifically excluded. Included are nucleic acid molecules where the encoded modified santalene synthase polypeptide contains a deletion of contiguous amino acid residues corresponding to amino acid residues from the first amino acid and up to and including at least one residue of the RR motif with reference to residues set forth in SEQ ID NO:1, such as, but not limited to, deletion of contiguous amino acids corresponding to amino acid residues from the first amino acid and up to and including amino acid residue 33, 34, 35, 36, 37, 38, 39, 40, 41, 42, 43, 44, 45, 46, 47, 48, 49 or 50 with reference to residues set forth in SEQ ID NO:1. Exemplary are modified santalene synthase polypeptides that lack amino acid residues corresponding to amino acid residues 1-33 with reference to residues set forth in SEQ ID NO:1.

Exemplary nucleic acid molecules that encode modified synthases that catalyze production of terpenes with an altered terpene profile are those that contain the nucleic acid sequence set forth in any of SEQ ID NOS: 44, 45-58, 62-69, 81-89, 92, 93, 96-104, 105, 106, 108, 111-128, 130, 219, 220, 222, 223, 225, 227, 228, 232, 234, 235, 236, 237, 238, 240-242, 263, 264, 265, 278-282, 287, 304 or 306-308, or a sequence that exhibits at least 85%, 86%, 87%, 88%, 89%, 90%, 91%, 92%, 93%, 94%, 95%, 96%, 97%, 98%, 99% or more sequence identity to any of SEQ ID NOS: 44, 45-58, 62-69, 81-89, 92, 93, 96-104, 105, 106, 108, 111-128, 130, 219, 220, 222, 223, 225, 227, 228, 232, 234, 235, 236, 237, 238, 240-242, 263, 264, 265, 278-282, 287, 304 and 306-308 and that encodes a modified santalene synthase polypeptide that contains the amino acid modification(s) or catalytically active fragments thereof that contain the modification.

Exemplary nucleic acid molecules include those where the encoded modified santalene synthase comprises the sequence of amino acids set forth in any of SEQ ID NO: 131-136, 139-142, 146-153, 164-169, 172, 177-179, 180-184, 186, 188-194, 196, 233, 243, 244, 245, 247, 249, 250, 254-257, 259-261, 267, 277, 283, 285, 286, 288 and 309-311, or a sequence that exhibits at least 85%, 86%, 87%, 88%, 89%, 90%, 91%, 92%, 93%, 94%, 95%, 96%, 97%, 98%, 99% or more sequence identity to any of SEQ ID NOS: 131-136, 139-142, 146-153, 164-169, 172, 177-179, 180-184, 186, 188-194, 196, 233, 243, 244, 245, 247, 249, 250, 254-257, 259-261, 267, 277, 283, 285, 286, 288 and 309-311 and that contains the amino acid modification(s), such as the encoded modified santalene synthase that comprises the sequence of amino acids set forth in any of SEQ ID NO: 131-136, 139-142, 146-153, 164-169, 172, 177-179, 180-184, 186, 188-194, 196, 233, 243, 244, 245, 247, 249, 250, 254-257, 259-261, 267, 277, 283, 285, 286, 288 and 309-311.

Altered terpene product profiles include decreased production of α-exo-bergamotene and increased production of a santalene compared to the santalene synthase encoded by the sequence of nucleotides set forth in SEQ ID NO:3. The santalene profile can include α-santalene, β-santalene, or α-santalene and β-santalene. Particular modifications that result in such altered profiles include modification(s) that include an amino acid replacement(s), where the amino acid replacement(s) are selected from among amino acid replacement(s) corresponding to M9T, D18N, T24I, T26N, A28S, A28G, S198N, E205Q, F282W, I313L, S329F, L335H, S338Y, C345P, V346A, S381G, S381P, F385L, S395A, F403Y and H404Y, or conservative replacement(s) thereof, with reference to amino acid positions set forth in SEQ ID NO:1, such as replacements selected from among amino acid residues V346A, A28G, F282W and C345P, or such as where the encoded modified santalene synthase polypeptide additionally includes the amino acid replacement K206T, such as where the encoded modified santalene synthase polypeptide comprises amino acid replacements K206T and F282W. Other exemplary nucleic acid molecules that encode synthases that catalyze production of terpenes with an altered terpene profile are those where the modified santalene synthase comprises a heterologous unstructured loop 1 domain or a contiguous portion thereof, containing at least 4, 5, 6, 7, 8, 9, 10, 15 or more amino acids, whereby amino acid residues corresponding to amino acids 1-31 of the santalene synthase polypeptide set forth in SEQ ID NO:1 are substituted with all or a portion of the corresponding region from a different terpene synthase. The different terpene synthase can be HVS whose sequence is set forth in SEQ ID NO:276 or a modified variant thereof that exhibits at least 80% sequence identity to SEQ ID NO:276 and exhibits activity to catalyze production of a terpene product from an acyclic pyrophosphate terpene precursor of the respective terpene synthase whose sequence is set forth in SEQ ID NO: 276. These molecules also include those that encode a modified santalene synthase that contains a heterologous unstructured loop 1 domain or a contiguous portion thereof, whereby amino acid residues corresponding to amino acid residues 1-31 of the santalene synthase set forth in SEQ ID NO:1 are substituted with amino acids MAPAIVMSNYEEEEIV (SEQ ID NO:202).

Exemplary of such nucleic acid molecules are those that contain the sequence of nucleotides set forth in any of SEQ ID NOS: 45, 49, 54, 57, 58, 62, 63, 66, 86, 92, 101, 111, 120, 225, 228, 234, 236, 281, 282, 287, 304 and 306-308, or a sequence that exhibits at least 85%, 86%, 87%, 88%, 89%, 90%, 91%, 92%, 93%, 94%, 95%, 96%, 97%, 98%, 99% or more sequence identity to any of SEQ ID NOS: 45, 49, 54, 57, 58, 62, 63, 66, 86, 92, 101, 111, 120, 225, 228, 234, 236, 281, 282, 287, 304 and 306-308 and that encodes a modified santalene synthase polypeptide that contains the amino acid modification(s), such as those that contain the nucleic acid sequence set forth in any of SEQ ID NOS: 45, 49, 54, 57, 58, 62, 63, 66, 86, 92, 101, 111, 120, 225, 228, 234, 236, 281, 282, 287, 304 and 306-308. Other exemplary nucleic acid molecules are those that encode a modified santalene synthase that contains the sequence of amino acids set forth in any of SEQ ID NOS: 131, 135, 139, 141, 142, 146, 147, 150, 166, 172, 179, 180, 181, 188, 191, 244, 247, 250, 255, 286, 288 and 309-311, or a sequence that exhibits at least 85%, 86%, 87%, 88%, 89%, 90%, 91%, 92%, 93%, 94%, 95%, 96%, 97%, 98%, 99% or more sequence identity to any of SEQ ID NOS: 131, 135, 139, 141, 142, 146, 147, 150, 166, 172, 179, 180, 181, 188, 191, 244, 247, 250, 255, 286, 288 and 309-311 and that contains the amino acid modification(s), such as the sequence of amino acids set forth in any of SEQ ID NOS: 131, 135, 139, 141, 142, 146, 147, 150, 166, 172, 179, 180, 181, 188, 191, 244, 247, 250, 255, 286, 288 and 309-311.

The altered product profile can include increased production of α-exo-bergamotene and decreased production of a santalene compared to the santalene synthase encoded by the sequence of nucleotides set forth in SEQ ID NO:3. The santalene can include α-santalene, β-santalene, or α-santalene and β-santalene. Exemplary of such nucleic acid molecules are those described above and in which the modification(s) comprise an amino acid replacement(s); and the amino acid replacement(s) are selected from among amino acid replacement(s) corresponding to C345L, C483R, T548A and T548S, or conservative replacement(s) thereof, with reference to amino acid positions set forth in SEQ ID NO:1. Other such nucleic acid molecules encode a modified santalene synthase that lacks or additionally lacks amino acid residues corresponding to amino acid residues 1-33 with reference to residues set forth in SEQ ID NO:1. Exemplary of such are those that contain the nucleic acid sequence set forth in any of SEQ ID NOS: 46-48, 50, 55, 56, 64, 65, 67, 68, 81-87, 96-100, 103-106, 108, 112-119, 121-128, 130, 219, 220, 222, 223, 227, 232, 235, 237, 240-242, 263-265, or 278-280, or a sequence that exhibits at least 85%, 86%, 87%, 88%, 89%, 90%, 91%, 92%, 93%, 94%, 95%, 96%, 97%, 98%, 99% or more sequence identity to any of SEQ ID NOS: 46-48, 50, 55, 56, 64, 65, 67, 68, 81-87, 96-100, 103-106, 108, 112-119, 121-128, 130, 219, 220, 222, 223, 227, 232, 235, 237, 240-242, 263-265, or 278-280 and that encodes a modified santalene synthase polypeptide that contains the amino acid modification(s), such as, for example, those that contain the nucleic acid sequence set forth in any of SEQ ID NOS: 86, 87, 232, 235 or 263, or a sequence that exhibits at least 85%, 86%, 87%, 88%, 89%, 90%, 91%, 92%, 93%, 94%, 95%, 96%, 97%, 98%, 99% or more sequence identity to any of SEQ ID NOS: 86, 87, 232, 235 or 263 and that encodes a modified santalene synthase polypeptide that contains the amino acid modification(s). These include nucleic acid molecules that contain the sequence of nucleotides set forth in any of SEQ ID NOS: 46-48, 50, 55, 56, 64, 65, 67, 68, 81-87, 96-100, 103-106, 108, 112-119, 121-128, 130, 219, 220, 222, 223, 227, 232, 235, 237, 240-242, 263-265, or 278-280. These include nucleic acid molecules where the encoded modified santalene synthase comprises the sequence of amino acids set forth in any of SEQ ID NOS: 132, 133, 134, 136, 140, 148, 149, 151, 152, 165, 167, 168, 177, 178, 183, 184, 186, 189, 190, 192, 193, 194, 196, 233, 243, 245, 249, 254, 256, 257, 260, 261, 267, 277, 283 and 285, or a sequence that exhibits at least 85%, 86%, 87%, 88%, 89%, 90%, 91%, 92%, 93%, 94%, 95%, 96%, 97%, 98%, 99% or more sequence identity to any of SEQ ID NOS: 132, 133, 134, 136, 140, 148, 149, 151, 152, 165, 167, 168, 177, 178, 183, 184, 186, 189, 190, 192, 193, 194, 196, 233, 243, 245, 249, 254, 256, 257, 260, 261, 267, 277, 283 and 285 and that contains the amino acid modification(s), such as where the encoded modified santalene synthase comprises the sequence of amino acids set forth in any of SEQ ID NO: 167, 168, 254, 256 or 267, or a sequence that exhibits at least 85%, 86%, 87%, 88%, 89%, 90%, 91%, 92%, 93%, 94%, 95%, 96%, 97%, 98%, 99% or more sequence identity to any of SEQ ID NOS: 167, 168, 254, 256 or 267 and that contains the amino acid modification(s).

Among these nucleic acid molecules that encode synthases that catalyze production of terpenes with an altered terpene profile are those where the encoded modified santalene synthase catalyzes the production of total terpene product(s) from farnesyl diphosphate (FPP) in a host cell in an amount that is greater than the amount of the same total terpene products produced from FPP by the santalene synthase encoded by the sequence of nucleotides set forth in SEQ ID NO:3 in the same host cell and under the same conditions. The host cell is a cell that produces an acyclic precursor, such as FPP; and the terpene product or product is a sesquiterpene. Terpene products include α-santalene, α-exo-bergamotene, epi-β-santalene, β-santalene, or stereoisomers and mixtures thereof. The total amount of terpene products, though altered in profile, can be increased when catalyzed by any of the encoded synthases, including the synthases that increase total products and those that result in an altered product profile. The increase can be such that the total terpene products produced from FPP by the modified santalene synthase is at least 103%, such as 105% to 500%, 110% to 250%, 125% to 500%, 125% to 250%, 130% to 500%, 130% to 250%, 150% to 500%, or 150% to 250% of the amount of total terpene products produced from FPP by the santalene synthase encoded by the sequence of nucleotides set forth in SEQ ID NO:3, such as where the amount of total terpene products produced from FPP by the modified santalene synthase is at least or at least about 105%, 106%, 107%, 108%, 109%, 110%, 115%, 120%, 125%, 130%, 135%, 140%, 145%, 150%, 160%, 170%, 180%, 200%, 250%, 300%, 350%, 400%, 500% or more of the amount of total terpene products produced from FPP by the santalene synthase encoded by the sequence of nucleotides set forth in SEQ ID NO:3.

Also provided are nucleic acid molecules and the encoded synthase, including catalytically active fragments of the synthase, that i) catalyze the production of total terpene product(s) from farnesyl diphosphate (FPP) in a host cell in an amount that is greater than the amount of the same total terpene products produced from FPP by the santalene synthase encoded by the sequence of nucleotides set forth in SEQ ID NO:3 in the same host cell and under the same conditions; and ii) catalyze the production of terpene products from farnesyl diphosphate (FPP) in a host cell with an altered product profile compared to the profile of the terpene products produced from FPP by the santalene synthase encoded by the sequence of nucleotides set forth in SEQ ID NO:3 in the same host cell and under the same conditions. The terpenes can be produced in vitro or in vivo. Where produced in a host cell, the host cell produces an acyclic the host cell is a cell that produces an acyclic pyrophosphate terpene precursor, such as FPP; the terpene product(s) include a sesquiterpene. In some embodiments the increased terpenes and altered profile include increased percentages of santalenes, such as α and/or β santalenes are produced. Exemplary of the nucleic acid molecules are those that encoded a synthase whose sequence is set forth in any of SEQ ID NOS: 179, 131, 172, 147, 255, 188, 142, 244, 247, 286, 309, 191, 166, 288, 250, 141, 310, 311 and 146, or a catalytically active fragment or portion thereof, and variants thereof that include the modifications and have at least 95% sequence identity with any of the polypeptides of SEQ ID NOS: 179, 131, 172, 147, 255, 188, 142, 244, 247, 286, 309, 191, 166, 288, 250, 141, 310, 311 and 146 or a catalytically active fragment or portion thereof. These include the synthases designated SaSSy-134-137, below, whose sequence is set forth in any of SEQ ID NOS: 244 and 309-311, or a catalytically active portion thereof.

Among the nucleic acid molecules provided herein that catalyze increased production of terpenes and/or an altered profile, include those in which the encoded synthase contains the amino acid replacements: 85Q/F101L/Y176F/T192A/C195Y/A240E/G323A/S329H/I330M/V346A/K350R/N353D/V433I/H446R/I465M/V502I. Also included are those in which the encoded synthase contains amino acid replacements at residues N183, K206 and F282. Also included are those that include or also include domain swaps selected from among swapBDS94-100/; swapCVS(V19)93-100/ or swapCVS(V19)114-144**/; and SaSSy198-

207swapCVS(Vv)187-195 with an optional additional K206 mutation within this domain swap.

For all of the nucleic acid molecules provided herein, the unmodified santalene synthase can be the synthase encoded by a sequence of nucleotides set forth in SEQ ID NO:2 or SEQ ID NO:3 or is a portion thereof encoding a catalytically active protein, such as, but not limited to, the unmodified santalene synthase whose sequence is set forth in SEQ ID NO:1 or is a catalytically active portion of the sequence of amino acids set forth in SEQ ID NO:1. The modified synthase can be a full-length sequence or a catalytically active fragment.

The encoding nucleic acid molecule can be a modified wild-type or a codon optimized sequence, where the codons are optimized for expression in a particular host cell, such as a yeast, such as, for example, Saccharomyces cerevisiae, or a plant cell.

Provided are the modified santalene synthase polypeptides encoded by each of the nucleic acid molecules provided and described herein. Also provided are cells containing the polypeptides and/or nucleic acid molecules, where, if the cells are human, they are isolated or cultured cells. Included among the encoded modified santalene synthase polypeptides are fusion proteins and chimeric proteins.

Also provided are vectors that contain each of the nucleic acid molecules provided herein, and vectors encoding each of the proteins provided herein. Vectors include prokaryotic and eukaryotic vectors, including, but not limited to, viral vectors for eukaryotic and prokaryotic expression and yeast vectors. Hence the vectors are eukaryotic and prokaryotic vectors. The vectors are for propagation of the nucleic acid molecules, and/or for expression of the encoded nucleic acid molecules for production of the encoded synthases and/or for production of terpenes. The cells include prokaryotic and eukaryotic cells, such as, but not limited to, bacteria, yeast, insect, plant and animal cells, including mammalian cells and cell lines. Exemplary of yeast cells are Saccharomyces genus and Pichia genus cells, such as Saccharomyces cerevisiae cells. Bacterial cells include, but are not limited to, Escherichia coli cells. Cells include plant cells. Also provided are transgenic plants that contain any of the nucleic acid molecules provided herein or any of the vectors and/or any of the cells. Plants and plant cells include those from the Solaniaceae family or the Lamiaceae family of plants.

For production of terpenes, the cells natively produce or are modified to produce a precursor thereof, such as an acyclic pyrophosphate precursor, such as arnesyl diphosphate (FPP). In some instances, the cells are modified to produce more of the precursor, such as FPP compared to an unmodified cell, such as by substitution of a promoter or introduction of heterologous nucleic acid coding for production of the precursor, such as FPP. Exemplary cells are those that are modified so that the biochemical pathways are altered to thereby increase production of a precursor, such as FPP. For example, modifications in the squalene synthase encoding gene (ERG9) can be included that result in decreased expression of squalene synthase expressed in the cell or a squalene synthase with decreased activity.

The cells can further include enzymes that catalyze reactions with terpenes, such as P450 enzymes, to alter product profiles or to produce particular terpenes. Exemplary are cells that include nucleic acid encoding a cytochrome P450 oxidase and/or a cytochrome P450 reductase that react with terpenes.

Methods are provided for producing a modified santalene synthase polypeptide, by introducing the nucleic acid molecule provided herein, or the vectors provided herein, into a cell; and culturing the cell under conditions whereby the encoded modified santalene synthase polypeptide is expressed. The cells can then be isolated and/or the modified synthase can be isolated or further modified.

Methods for producing terpene products are provided. The methods can be performed in vivo, such as in a cell as provided herein. Methods also can be performed in vitro, such as by reacting purified products or using cell lysates. For example, methods are provided that include contacting an acyclic pyrophosphate terpene precursor with a modified santalene synthase polypeptide provided herein under conditions suitable for the formation of terpene products from the acyclic pyrophosphate terpene precursor. A product or the products can then be isolated. Acyclic pyrophosphate terpene precursors include, but are not limited to, farnesyl diphosphate (FPP), geranyl diphosphate (GPP) and geranylgeranyl diphosphate (GGPP).

For in vivo methods, a terpene product can be produced by culturing a cell containing any of the nucleic acid molecule or the vector provided herein under conditions whereby the cell produces an acyclic pyrophosphate terpene precursor; the modified santalene synthase polypeptide encoded by the nucleic acid molecule or vector is expressed; the modified santalene synthase polypeptide catalyzes the formation of a terpene product(s) from the acyclic pyrophosphate terpene precursor. A terpene product or products can be isolated or the cells with the terpene products can be isolated. As noted above, cells include bacteria, yeast, insect, plant and animal cells, such as mammalian cells. If the cell is a human cell, it is isolated or cultured. Among the cells, are yeast cells, such as Saccharomyces cerevisiae cells. The cells can be modified to produce more acyclic pyrophosphate precursor, such as FPP, compared to an unmodified cell. As noted above, among such cells are cells that produce reduced amounts of squalene, such as by modifying the synthase. Terpene products include, but are not limited to, α-santalene, α-exo-bergamotene, epi-β-santalene, β-santalene, stereoisomers, and mixtures thereof. One product or a mixture can be isolated.

The isolated product(s) can be further modified, such as by treating the terpene to produce a respective alcohol or mixture of alcohols. Such alcohols include, but are not limited to, α-santalol, β-santalol, α-trans-bergamotol, epi-β-santalol, stereoisomers, and mixtures thereof. Processing can be performed biosynthetically, such as enzymatically, such as by a P450 enzyme, such as an oxidase, or chemically, or mixture of both. For example, the cells can express a P450 enzyme, either natively or by modification, so that the resulting alcohol is produced in a cell. Thus, for example, a cytochrome P450 oxidase can be contacted with the terpene products in vivo in a host cell that expresses the modified santalene synthase polypeptide and cytochrome P450 oxidase; and the method includes culturing the host cell under conditions suitable for the formation of a santalol, bergamotol and/or mixtures thereof. A P450 reductase also can be included in the cell. A resulting alcohol or mixture can be isolated, such as by extraction with an organic solvent and/or column chromatography.

BRIEF DESCRIPTION OF THE FIGURES

FIG. 1A depicts the pathway by which santalene synthase catalyzes the formation of santalenes and bergamotene, and the subsequent conversion to their respective alcohols. FIG. 1B depicts the chemical structure of the produced santalenes and bergamotene and their corresponding alcohols, including stereoisomers thereof, including α-santalene (1), β-santalene (2), epi-β-santalene (3) and α-trans-bergamotene (4), (Z)-α-santalol (5), (E)-α-santalol (6), (Z)-β-santalol (7), (E)β-santalol (8), (E)-epi-β-santalol (9), (Z)-epi-β-santalol (10), (Z)-α-trans-bergamotol (11), (E)-α-trans-bergamotol (12).

FIG. 2 (A-F) depicts exemplary alignments of *Santalum album* santalene synthase set forth in SEQ ID NO:1 (SaSSy) with other SaSSy polypeptides. A "*" means that the aligned residues are identical, a ":" means that aligned residues are not identical, but are similar and contain conservative amino acids residues at the aligned position, and a "." means that the aligned residues are similar and contain semi-conservative amino acid residues at the aligned position. The RR motif is highlighted and underlined in each sequence. Also, exemplary, non-limiting, amino acid replacements are indicated by highlighting to depict identification of corresponding residues between and among synthases. For example, FIG. 2A depicts the alignment of SaSSy set forth in SEQ ID NO:1 with SaSSy set forth in SEQ ID NO:27 (Genbank Accession No. ADP30867. FIG. 2B depicts the alignment of SaSSy set forth in SEQ ID NO:1 with SaSSy set forth in SEQ ID NO:28 (U.S. Pat. Pub. No. 20110281257). FIG. 2C depicts the alignment of SaSSy set forth in SEQ ID NO:1 with SaSSy set forth in SEQ ID NO:29 (U.S. Pat. Pub. No. 20110281257). FIG. 2D depicts the alignment of SaSSy set forth in SEQ ID NO:1 with SaSSy set forth in SEQ ID NO:30 (U.S. Pat. Pub. No. 20110281257). FIG. 2E depicts the alignment of SaSSy set forth in SEQ ID NO:1 with SaSSy set forth in SEQ ID NO:31 (U.S. Pat. Pub. No. 20110281257). FIG. 2F depicts the alignment of SaSSy set forth in SEQ ID NO:1 with SaSSy set forth in SEQ ID NO:32 (U.S. Pat. Pub. No. 20110281257).

FIG. 3 (A-C) depicts exemplary alignments of *Santalum album* santalene synthase set forth in SEQ ID NO:1 (SaSSy) with other *Santalum*-santalene synthase polypeptides. A "*" means that the aligned residues are identical, a ":" means that aligned residues are not identical, but are similar and contain conservative amino acids residues at the aligned position, and a "." means that the aligned residues are similar and contain semi-conservative amino acid residues at the aligned position. The RR motif is highlighted and underlined in each sequence. Also, exemplary, non-limiting amino acid replacements are indicated by highlighting to depict identification of corresponding residues between and among synthases. For example, FIG. 3A depicts the alignment of SaSSy set forth in SEQ ID NO:1 with santalene synthase from *Santalum spicatum* (SspiSSy) set forth in SEQ ID NO:10. FIG. 3B depicts the alignment of SaSSy set forth in SEQ ID NO:1 with santalene synthase from *Santalum austrocaledonicum* (SauSSy) set forth in SEQ ID NO:12. FIG. 3C depicts the alignment of SaSSy set forth in SEQ ID NO:1 with santalene synthase from *Santalum murrayanum* (SmSSy) set forth in SEQ ID NO:14.

DETAILED DESCRIPTION

Figure 1A:
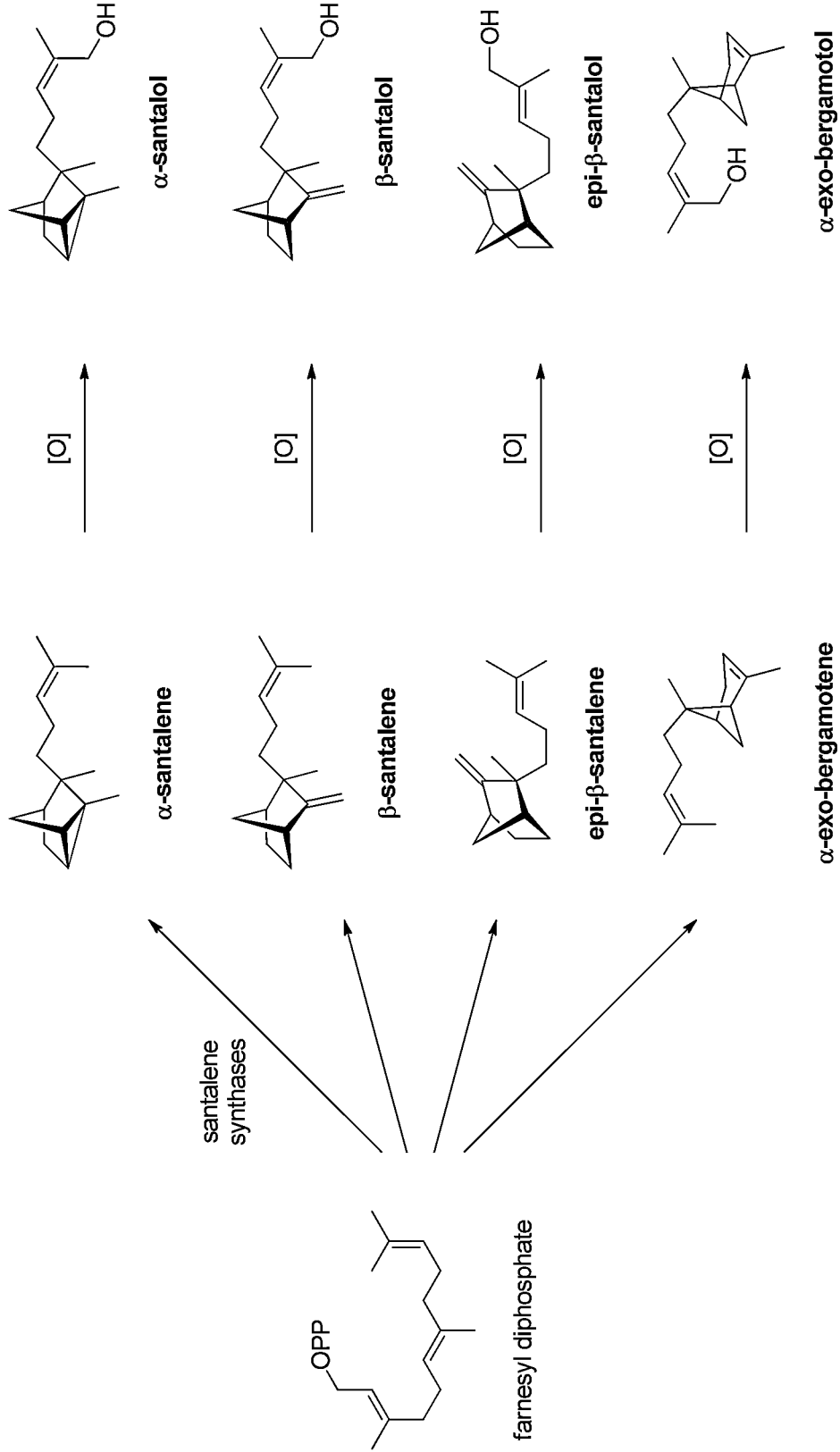
FIG. 1A-1B.

A. Definitions
B. Santalene Synthase and Production of Santalenes and Other Products
  1. Santalene Synthase Function and Activity
  2. Structure of Santalene Synthases
C. Modified Santalene Synthase Polypeptides and Encoding Nucleic Acid Molecules
  1. Exemplary Modifications
    a. Codon-Optimization
    b. Amino Acid Replacements
    c. N-terminal or C-terminal Deletions
    d. Domain Swaps
  2. Exemplary Modified Polypeptides and Encoding Nucleic Acid Molecules
  3. Fusion Proteins and Other Forms of Additional Modifications
D. Production of modified santalene synthase polypeptides and encoding nucleic acid molecules
  1. Isolation of nucleic acid encoding santalene synthases
  2. Generation of modified nucleic acid
  3. Fusion Proteins
  4. Vectors and Cells
  5. Expression systems
    a. Prokaryotic cells
    b. Yeast cells
    c. Plants and plant cells
    d. Insects and insect cells
    e. Mammalian cells
  6. Purification
E. Methods of Producing Terpenes and Terpenoids Using Santalene Synthase Polypeptides and Encoding Nucleic Acid Molecules
  1. Production of Terpene Products (e.g., Santalenes and Bergamotenes)
    a. Exemplary cells
    b. Culture of cells for Terpene Production
    c. Isolation and assays for detection and identification of Terpene Products (e.g., santalenes and bergamotene)
  2. Production of Terpenoids (e.g., Santalols and Bergamotols)
F. Examples A. Definitions Unless defined otherwise, all technical and scientific terms used herein have the same meaning as is commonly understood by one of skill in the art to which the invention(s) belong. All patents, patent applications, published applications and publications, GENBANK sequences, websites and other published materials referred to throughout the entire disclosure herein, unless noted otherwise, are incorporated by reference in their entirety. In the event that there is a plurality of definitions for terms herein, those in this section prevail. Where reference is made to a URL or other such identifier or address, it is understood that such identifiers can change and particular information on the internet can come and go, but equivalent information is known and can be readily accessed, such as by searching the internet and/or appropriate databases. Reference thereto evidences the availability and public dissemination of such information.

As used herein, an acyclic pyrophosphate terpene precursor is any acyclic pyrophosphate compound that is a precursor to the production of at least one terpene, including, but not limited to, farnesyl-pyrophosphate (FPP), geranyl-pyrophosphate (GPP), and geranylgeranyl-pyrophosphate (GGPP). Acyclic pyrophosphate terpene precursors are thus substrates for terpene synthases.

As used herein, a terpene synthase is a polypeptide capable of catalyzing the formation of one or more terpenes from a pyrophosphate terpene precursor. In some examples, a terpene synthase catalyzes the formation of one or more terpenes from an acyclic pyrophosphate terpene precursor, for example, FPP, GPP or GGPP, including, but not limited to, santalene synthase. In other examples, a terpene synthase catalyzes the formation of one or more terpenes from an acyclic pyrophosphate terpene precursor, including, but not limited to, santalene synthase.

As used herein, a santalene synthase is a synthase that catalyzes the formation of one or more terpenes from FPP that include, for example, one or more terpenes selected from among α-santalene, α-exo-bergamotene (also called α-trans-bergamotene), epi-β-santalene, and β-santalene, in various amounts, and typically α-santalene (25-65%), α-trans-bergamotene (1-20%), epi-β-santalene (1-15%) and β-santalene (20-50%), such as α-santalene (38.0%) α-trans-bergamotene (12.1%) epi-β-santalene (4.7%) and β-santalene (45.2%). It is understood, however, that the relative amount of terpene products produced can be altered by the modified santalene synthase provided herein.

As used herein, a terpene is an unsaturated hydrocarbon based on the isoprene unit ($C_5H_8$), and having a general formula $C_{5x}H_{8x}$, such as $C_{10}H_{16}$. Reference to a terpene includes acyclic, monocyclic and polycyclic terpenes. Terpenes include, but are not limited to, monoterpenes, which contain 10 carbon atoms; sesquiterpenes, which contain 15 carbon atoms; diterpenes, which contain 20 carbon atoms, and triterpenes, which contain 30 carbon atoms. Reference to a terpene also includes stereoisomers of the terpene.

Figure 1B:
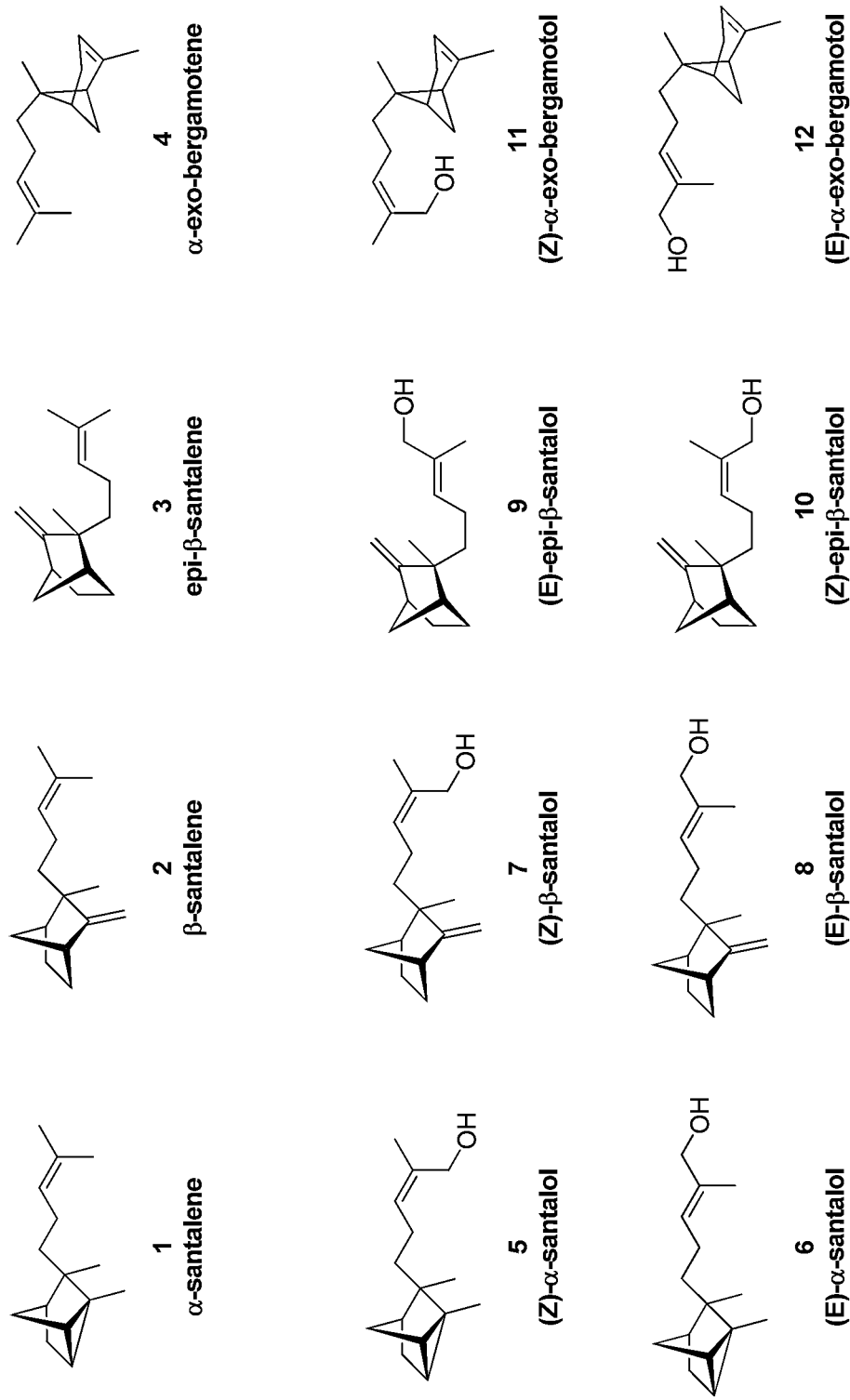

As used herein, a santalene refers to α-santalene and β-santalene, and any stereoisomer thereof, including, for example, (+)-epi-β-santalene, (−)-β-santalene, (+)-β-santalene, (+)-α-santalene, and (−)-α-santalene as described in FIG. 1A or FIG. 1B.

As used herein, α-santalene is a sesquiterpene having the following structure or stereoisomers thereof:

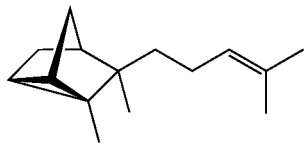

As used herein, β-santalene is a sesquiterpene having the following structure or stereoisomers thereof:

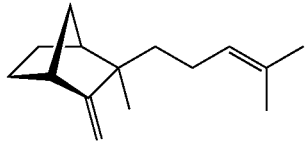

As used herein, epi-β-santalene is a sesquiterpene having the following structure or stereoisomers thereof:

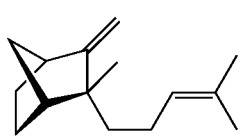

As used herein, α-trans-bergamotene or α-exo-bergamotene is a sesquiterpene having the following structure or stereoisomers thereof:

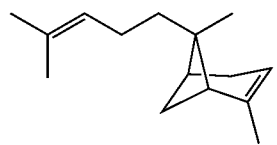

As used herein, a terpenoid is a chemically modified terpene. In one example, a terpenoid is a terpene that has been chemically modified by addition of a hydroxyl group, such as a santalol or bergamotol. Reference to a terpenoid includes acyclic, monocyclic and polycyclic terpenoids, including monoterpenoids, sesquiterpenoids and diterpenoids. Reference to a terpenoid also includes stereoisomers of the terpenoid.

As used herein, a santalol refers to α-santalol and β-santalol, and any stereoisomer thereof, including, for example, (Z)-α-santalol, (E)-α-santalol, (Z)-β-santalol, (E)-β-santalol, (E)-epi-β-santalol or (Z)-epi-β-santalol as described in FIG. 1A or FIG. 1B.

As used herein, a bergamotol refers to α-exo-bergamotol, and any stereoisomer thereof, including, for example, (Z)-α-exo-bergamotol or (E)-α-exo-bergamotol as described in FIG. 1A or FIG. 1B.

As used herein, α-santalol is a sesquiterpenoid having the following structure or stereoisomers thereof:

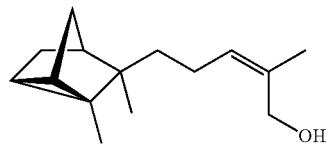

As used herein, β-santalol is a sesquiterpenoid having the following structure or stereoisomers thereof:

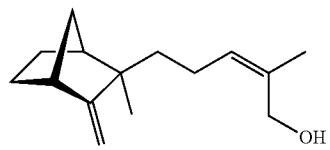

As used herein, epi-β-santalol is a sesquiterpenoid having the following structure or stereoisomers thereof:

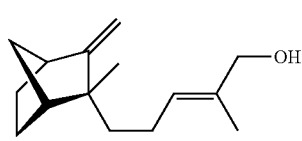

As used herein, Z-α-trans-bergamotol or Z-α-exo-bergamotol is a sesquiterpenoid having the following structure or stereoisomers thereof:

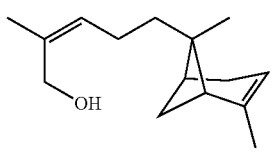 [SMILES: CC1=CCC2CC1C2(C)CC/C=C(/C)CO]

As used herein, E-α-trans-bergamotol or E-α-exo-bergamotol is a sesquiterpenoid having the following structure or stereoisomers thereof:

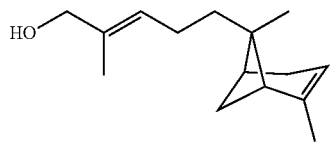 [SMILES: CC1=CCC2CC1C2(C)CC/C=C(\C)CO]

As used herein, "cytochrome P450," "cytochrome P450 oxidase," "cytochrome P450 polypeptide," or "cytochrome P450 oxidase polypeptide" is a polypeptide capable of catalyzing the monooxygenation of any terpene precursor, including monoterpenes, sesquiterpenes and diterpenes. A cytochrome P450 can catalyze the monooxygenation of a terpene or a mixture of terpenes, resulting in the production one or more terpenoids.

As used herein, "cytochrome P450 reductase" or "CPR" is a polypeptide capable of catalyzing the transfer of two electrons from NADPH to an electron acceptor, such as a cytochrome P450.

As used herein, terpene production refers to the amount (in weight or weight/volume) of terpene or terpenes that is/are produced upon the reaction of a terpene synthase (e.g., santalene synthase) to catalyze the formation of one or more terpenes from a pyrophosphate terpene precursor. Reference to total terpene production refers to the total amount of all terpenes produced from the reaction, while reference to particular terpene production refers to the amount of a particular terpene (e.g., β-santalene and α-santalene) produced from the reaction.

As used herein, an improved or increased total terpene production refers to an increase in the total amount of terpene products (i.e. improved total terpene production) resulting from the reaction of an acyclic pyrophosphate terpene precursor (e.g., FPP) with a modified santalene synthase compared to the amount produced from the reaction of the same acyclic pyrophosphate terpene precursor (e.g., FPP) with a santalene synthase that is not so modified, and under the same conditions. For example, total terpene production is increased if the amount of total terpene products resulting from the reaction of an acyclic pyrophosphate terpene precursor (e.g., FPP) with a modified santalene synthase is greater than the amount of the total terpene products resulting from reaction of the same acyclic pyrophosphate terpene precursor (e.g., FPP) with a santalene synthase set forth in SEQ ID NO:1 and encoded by the sequence of nucleotides set forth in SEQ ID NO:2 or SEQ ID NO:3 and under the same conditions. The amount of total terpenes produced from the reaction by a modified santalene synthase can be increased by at least or at least about 1%, 3%, 5%, 10%, 15%, 20%, 30%, 40%, 50%, 60%, 70%, 80%, 90%, 100% or more compared to the amount of terpenes produced from the reaction of the same acyclic pyrophosphate terpene precursor (e.g., FPP) and under the same conditions with a santalene synthase that is not so modified, such as the santalene synthase encoded by the sequence of nucleotides set forth in SEQ ID NO:2 or SEQ ID NO:3. In particular, for purposes herein, reference to an increased or improved total terpene production means that a modified santalene synthase catalyzes the production of terpene from FPP in an amount that is greater than the amount of terpene products resulting from the reaction of FPP by the santalene synthase encoded by the sequence of nucleotides set forth in SEQ ID NO:3.

As used herein, "product distribution" or "product profile" refers to the relative amounts of different terpene produced from the reaction between an acyclic pyrophosphate terpene precursor (e.g., FPP) and a terpene synthase (e.g., santalene synthase). The amount of a produced terpene can be depicted as a percentage of the total products produced by the santalene synthase. For example, the product distribution or profile resulting from reaction of a native or wild type santalene synthase (e.g., santalene synthase from *Santalum Album* set forth in SEQ ID NO:1) is typically: α-santalene (25-65%), α-exo-bergamotene (1-20%), epi-β-santalene (1-15%) and β-santalene (20-50%), such as α-santalene (38.0%), α-trans-bergamotene (12.1%), epi-β-santalene (4.7%), and β-santalene (45.2%), but can be altered as described herein. Methods for assessing the type and amount of a terpene in a solution are well known in the art and described herein, and include, for example, gas chromatography-mass spectrometry (GC-MS) or gas chromatography with flame ionization detector (GC-FID) (see Examples below).

As used herein, an altered product distribution refers to a change in the relative amount of individual terpene products (e.g., α-santalene, α-exo-bergamotene, epi-β-santalene, and β-santalene) produced, and generally a change in at least one terpene product produced, from the reaction between an acyclic pyrophosphate terpene precursor (e.g., FPP) and a modified santalene synthase. Typically, the change is assessed by determining the relative amount of each individual terpene product produced from reaction of a modified santalene synthase with an acyclic pyrophosphate terpene precursor (e.g., FPP) as a percentage of the relative amount of each respective terpene produced from reaction of an unmodified santalene synthase with the same acyclic pyrophosphate terpene precursor (e.g., FPP) and under the same conditions. For example, an altered profile exists if there is a change (e.g., increase or decrease) in the relative amount of at least one terpene product produced from reaction of a modified santalene synthase with an acyclic pyrophosphate terpene precursor (e.g., FPP) as a percentage of the relative amount of each respective terpene produced from reaction of the unmodified santalene synthase set forth in SEQ ID NO:1 and encoded by the sequence of nucleotides set forth in SEQ ID NO:2 or SEQ ID NO:3, with the same acyclic pyrophosphate terpene precursor (e.g., FPP) and under the same conditions. In particular, for purposes herein, reference to an altered product distribution means that a modified santalene synthase catalyzes the production of at least one terpene product from FPP (e.g., at least 1, 2, 3 or more of α-santalene, α-exo-bergamotene, epi-β-santalene, and/or β-santalene) in an amount or as a percentage that is increased or decreased compared to the amount or percentage of the terpene product produced from the reaction of FPP with the santalene synthase encoded by the sequence of nucleotides set forth in SEQ ID NO:3 and under the same conditions. An altered product distribution is considered to occur if the relative amount or percentage of at least one terpene product (e.g., α-santalene, α-exo-bergamotene, epi-β-santalene, and/or β-santalene) is increased or decreased by at least or by at least about 0.5%, 1%, 2%, 3%, 4%, 5%, 6%, 7%, 8%, 9%, 10%, 15%, 20%, 25%, 30%, 35%, 40%, 50%, 60%, 70%, 80% or more compared to the amount or percentage of the terpene produced from the unmodified santalene synthase.

As used herein, an improved product distribution or product profile refers to a change in the product distribution to one that is more desirable, i.e. contains more desirable relative amounts of terpenes. For example, an improved product distribution can contain an increased amount of a desired terpene and/or a decreased amount of a terpene that is not so desired. For example, in some cases, a modified santalene synthase that produces an increase in a santalene (α-santalene, epi-β-santalene, and/or β-santalene) is desired. In other cases, a modified santalene synthase that produces a decrease in α-exo-bergamotene is desired. In still other cases, a modified santalene synthase that produces an increase in α-exo-bergamotene is desired. The amount of desired terpene in an improved production distribution can be increased by at least or by at least about 0.5%, 1%, 2%, 3%, 4%, 5%, 6%, 7%, 8%, 9%, 10%, 15%, 20%, 25%, 30%, 35%, 40%, 50%, 60%, 70%, 80% or more compared to the amount of the terpene produced by the unmodified santalene synthase, such as the unmodified santalene synthase set forth in SEQ ID NO:1 and encoded by the sequence of nucleotides set forth in SEQ ID NO:2 or SEQ ID NO:3. The amount of a terpene that is not desired in an improved production distribution can be decreased by at least or by at least about 0.5%, 1%, 2%, 3%, 4%, 5%, 6%, 7%, 8%, 9%, 10%, 15%, 20%, 25%, 30%, 35%, 40%, 50%, 60%, 70%, 80% or more compared to the amount of the terpene produced by the unmodified santalene synthase, such as the unmodified santalene synthase set forth in SEQ ID NO:1 and encoded by the sequence of nucleotides set forth in SEQ ID NO:2 or SEQ ID NO:3.

As used herein, species variants refer to variants in polypeptides among different species, including different *Santalum* species, such as *Santalum Album*.

As used herein, allelic variants refer to variations in encoded proteins among members of the same species.

As used herein, a splice variant refers to a variant produced by differential processing of a primary transcript of genomic DNA that results in more than one type of mRNA.

As used herein, an "unmodified santalene synthase" refers to a starting polypeptide or catalytically fragment thereof that is selected for modification as provided herein. The starting target polypeptide can be a wild-type or reference santalene synthase, which is a predominant reference polypeptide to which activity is assessed. For example, santalene synthase from *Santalum album*, such as set forth in SEQ ID NO:1, is a predominant or reference polypeptide for modification herein. Other known santalene synthases in the art, including any in the art that have been modified, can be selected and used as the starting unmodified target protein. For example, any of SEQ ID NOS:1, 10, 12, 14, 27-43 or 258, catalytically active fragments thereof, or any variant thereof that has at least 60%, 70%, 80%, 85%, 86%, 87%, 88%, 89%, 90%, 91%, 92%, 93%, 94%, 95%, 96%, 97%, 98%, or 99% sequence identity to a santalene synthase polypeptide set forth in any of SEQ ID NOS:1, 10, 12, 14, 27-43 or 258 or a catalytically active fragment thereof, can be selected or used as the starting unmodified santalene synthase.

As used herein, "catalytically active" with reference to a santalene synthase refers to the ability of a santalene synthase (or fragment or portion thereof) to catalyze the formation of terpene products from an acyclic pyrophosphate terpene precursor, such as FPP. Typically, a santalene synthase is catalytically active if it catalyzes the formation of α-santalene, α-exo-bergamotene, epi-β-santalene, and/or β-santalene from FPP.

As used herein, "portion thereof," or "catalytically active portion" or "catalytically active fragment" with reference to a santalene synthase refers to a santalene synthase that is less than full-length, but that contains a sufficient contiguous portion of amino acids of a santalene synthase so that the portion that is catalytically active (catalyzes production of a terpene from an acyclic pyrophosphate terpene precursor).

As used herein, "RR-motif" refers to a sequence of amino acids at the N-terminus of a terpene synthase, such as a santalene synthase, that has the formula $R(R/P)(X)_8W$ (SEQ ID NO:291).

As used herein, aspartate-rich motif refers to a sequence of amino acids in the C-terminal domain of a terpene synthase, such as a santalene synthase, that has the formula DDxxD (designated aspartate-rich region 1, e.g., residues 321-325 of SEQ ID NO:1) or [N/D]xxx[S/T]xxxE (designated aspartate-rich region 2, SEQ ID NO:173). The aspartate-rich motif is involved in the coordination of divalent ions, water molecules and the stabilization of the active site.

As used herein, "modified santalene synthase polypeptide" refers to a santalene synthase polypeptide that has one or more amino acid or nucleotide differences compared to an unmodified or wild-type santalene synthase polypeptide. For example, with reference to amino acid differences, the one or more amino acid differences can be amino acid or nucleotide mutations such as one or more amino acid replacements (substitutions), insertions or deletions, or can be insertions or deletions of entire domains, and any combinations thereof. Typically, a modified santalene synthase polypeptide has one or more modifications in primary sequence compared to an unmodified or wild-type santalene synthase polypeptide. For example, a modified santalene synthase polypeptide provided herein can have at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 90, 95, 100, 105, 110, 115, 120, 125, 130, 135 or more amino acid or nucleotide differences compared to an unmodified santalene synthase polypeptide. Any modification is contemplated as long as the resulting polypeptide or encoded polypeptide exhibits at least one santalene synthase activity associated with a wild-type santalene synthase polypeptide, such as, for example, catalytic activity, the ability to bind FPP, and/or the ability to catalyze the formation of α-santalene, β-santalene, α-exo-bergamotene and/or epi-β-santalene from FPP.

As used herein, modification is in reference to modification of a sequence of amino acids of a polypeptide or a sequence of nucleotides in a nucleic acid molecule and includes deletions, insertions, and replacements of amino acids and nucleotides, respectively. For purposes herein, amino acid replacements (or substitutions), deletions and/or insertions, can be made in any of the santalene synthases provided herein. Modifications can be made by making conservative amino acid replacements and also non-conservative amino acid substitutions. For example, amino acid replacements that desirably or advantageously alter properties of the santalene synthase can be made. For example, amino acid replacements can be made to the santalene synthase such that the resulting modified santalene synthase can produce more terpene products from FPP compared to an unmodified santalene synthase.

As used herein, "codon optimized" or "codon optimization" refers to the process of modifying or changing codons in a nucleotide sequence to codons that are preferred or more closely match the pattern of codon usage in the organism used for expression of the molecule. Thus, codons can be optimized for usage in a particular organism in which expression is desired based on known codon usage in the organism in order to enhance the effectiveness of expression of the nucleic acid, e.g., to achieve faster translation rates and high accuracy. The codon usage in a particular organism is known.

As used herein, "deletion," when referring to a nucleic acid or polypeptide sequence, refers to the deletion of one or more nucleotides or amino acids compared to a sequence, such as a target polynucleotide or polypeptide or a native or wild-type sequence.

As used herein, "insertion" when referring to a nucleic acid or amino acid sequence, describes the inclusion of one or more additional nucleotides or amino acids, within a target, native, wild-type or other related sequence. Thus, a nucleic acid molecule that contains one or more insertions compared to a wild-type sequence contains one or more additional nucleotides within the linear length of the sequence.

As used herein, "additions," to nucleic acid and amino acid sequences describe the addition of nucleotides or amino acids onto either termini compared to another sequence.

As used herein, "substitution" or "replacement" refers to the replacing of one or more nucleotides or amino acids in a native, target, wild-type or other nucleic acid or polypeptide sequence with an alternative nucleotide or amino acid, without changing the length (as described in numbers of residues) of the molecule. Thus, one or more substitutions in a molecule does not change the number of amino acid residues or nucleotides of the molecule. Amino acid replacements compared to a particular polypeptide can be expressed in terms of the number of the amino acid residue along the length of the polypeptide sequence. For example, a modified polypeptide having a modification in the amino acid at the $282^{th}$ position of the amino acid sequence that is a substitution of Phenylalanine (Phe; F) for tryptophan (Trp; W) can be expressed as F282W.

As used herein, "at a position corresponding to" or recitation that nucleotides or amino acid positions "correspond to" nucleotides or amino acid positions in a disclosed sequence, such as set forth in the Sequence listing, refers to nucleotides or amino acid positions identified upon alignment with the disclosed sequence to maximize identity using a standard alignment algorithm, such as the GAP algorithm. For purposes herein, residues for modification provided herein are with reference to amino acid positions set forth in the santalene synthase set forth in SEQ ID NO:1. Hence, corresponding residues in another santalene synthase can be determined by alignment of a reference santalene synthase, or portion thereof, with the sequence set forth in SEQ ID NO:1. By aligning the sequences, one skilled in the art can identify corresponding residues, for example, using conserved and identical amino acid residues as guides. In general, to identify corresponding positions, the sequences of amino acids are aligned so that the highest order match is obtained (see, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part I*, Griffin, A. M., and Griffin, H. G., eds., Humana Press, New Jersey, 1994; *Sequence Analysis in Molecular Biology*, von Heijne, G., Academic Press, 1987; and *Sequence Analysis Primer*, Gribskov, M. and Devereux, J., eds., M Stockton Press, New York, 1991; Carrillo et al. (1988) *SIAM J Applied Math* 48:1073). Exemplary alignments are provided in FIGS. 2A-F and FIGS. 3A-C.

As used herein, domain or region (typically a sequence of three or more, generally 5 or 7 or more amino acids) refers to a portion of a molecule, such as a protein or the encoding nucleic acids, that is structurally and/or functionally distinct from other portions of the molecule and is identifiable. A protein can have one, or more than one, distinct domains. For example, a domain can be identified, defined or distinguished by homology of the sequence therein to related family members, such as other terpene synthases. A domain can be a linear sequence of amino acids or a non-linear sequence of amino acids. Many polypeptides contain a plurality of domains. Such domains are known, and can be identified by, those of skill in the art. For exemplification herein, definitions are provided, but it is understood that it is well within the skill in the art to recognize particular domains by name. If needed appropriate software can be employed to identify domains. For example, as discussed above, corresponding domains in different terpene synthases can be identified by sequence alignments, such as using tools and algorithms well known in the art (for example, BLASTP).

As used herein, a functional domain refers to those portions of a polypeptide that is recognized by virtue of a functional activity, such as catalytic activity. A functional domain can be distinguished by its function, such as by catalytic activity, or an ability to interact with a biomolecule, such as substrate binding or metal binding. In some examples, a domain independently can exhibit a biological function or property such that the domain independently or fused to another molecule can perform an activity, such as, for example catalytic activity or substrate binding.

As used herein, a structural domain refers to those portions of a polypeptide chain that can form an independently folded structure within a protein made up of one or more structural motifs.

As used herein "a domain swap" with reference to a modified santalene synthase refers to a santalene synthase that contains a sequence that is modified to contain heterologous amino acids (or encoding nucleic acids) of the corresponding domain or domains, or part of a contiguous portion of a heterologous domain or domains, of another terpene synthase. Hence, the modified santalene synthase is a chimeric molecule or hybrid containing a region or regions of another terpene synthase. Any functional or structural domain of a santalene synthase can be modified to the corresponding domain or contiguous portion thereof of another terpene synthase. Typically, a domain swap is a modification that results in replacement, insertion or deletion of at least three or more, and typically at least 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 or more amino acids.

As used herein, "contiguous" or "contiguous portion" refers to a linear, uninterrupted sequence of amino acids with reference to a sequence, domain or portions thereof. For example, a contiguous portion with reference to a structural domain means that the sequence contains a linear and uninterrupted sequence of amino acids that make up part of the domain. Typically, a contiguous portion of a domain is less than the full-length sequence of residues that make-up the domain or structural domain, and generally is at least 3 amino acids, such as at least 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 or more amino acids. A contiguous portion with reference to a santalene synthase can include any number of linear, uninterrupted amino acids of a santalene synthase that is less than the full-length sequence, so long as the santalene synthase is catalytically active. For example, a contiguous portion with reference to a catalytically active fragment of a santalene synthase is less than full-length, and generally at least 300 amino acids in length, such as at least or 305, 315, 330, 340, 350, 360, 370, 380, 390, 400, 410, 420, 430, 440, 450, 460, 470, 480, 490, 500, 510, 520, 530, 540, 550 or more.

As used herein, "heterologous" with respect to an amino acid or nucleic acid sequence refers to portions of a sequence that is not present in the native polypeptide or encoded by the native polynucleotide. For example, a portion of amino acids of a polypeptide, such as a domain or region or portion thereof, for a santalene synthase is heterologous thereto if such amino acids is not present in a native or wild-type santalene synthase (e.g., as set forth in SEQ ID NO:1), or encoded by the polynucleotide encoding therefor. Polypeptides containing such heterologous amino acids or polynucleotides encoding therefor are referred to as "chimeric polypeptides" or "chimeric polynucleotides," respectively.

As used herein, "N-terminus" or "N-terminal domain" refers to the amino acid residues at the start of a protein or polypeptide that includes the terminal amino acid residue with a free amine group ($-NH_2$). Reference to the N-terminus or N-terminal domain refers to any number of contiguous residues from the N-terminal residue and that includes the terminal amino acid residue. For example, reference to the N-terminus can include any number of residues up to and including amino acid residues 1-42 with reference to SEQ ID NO:1, or a portion thereof.

As used herein, "C-terminus" or "C-terminal domain" refers to the amino acid residues at the end of a protein or polypeptide that includes the terminal amino acid residue with a free carboxyl group (—COOH). For example, reference to the C-terminus or C-terminal domain refers to any number of contiguous residues from the C-terminal residue and that includes the terminal amino acid residue.

As used herein, "under the same conditions" with reference to production of terpene products means that the reaction by which a terpene product is catalyzed from an acyclic pyrophosphate terpene precursor by a santalene synthase is identical or substantially identical between and among tested molecules, such that any one or more conditions that can influence the production of a terpene are not varied or not substantially varied between the test agents, except for the difference in the santalene synthase itself. For example, any one or more conditions such as the particular host cell; acyclic pyrophosphate terpene precursor; fermentation medium, temperature of culture; time of culture; type of flask or microculture; pH adjustment, extraction method and/or other conditions associated with terpene production are identical or substantially identical between and among the compared polypeptides.

As used herein, nucleic acids or nucleic acid molecules include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule cannot be paired. Such unpaired ends will, in general, not exceed 40 or 50 nucleotides in length.

As used herein, heterologous nucleic acid is nucleic acid that is not normally produced in vivo by the cell in which it is expressed or that is produced by the cell but is at a different locus or expressed differently or that mediates or encodes mediators that alter expression of endogenous nucleic acid, such as DNA, by affecting transcription, translation, or other regulatable biochemical processes. Heterologous nucleic acid is generally not endogenous to the cell into which it is introduced, but has been obtained from another cell or prepared synthetically. Heterologous nucleic acid can be endogenous, but is nucleic acid that is expressed from a different locus or altered in its expression. Generally, although not necessarily, such nucleic acid encodes RNA and proteins that are not normally produced by the cell or in the same way in the cell in which it is expressed. Heterologous nucleic acid, such as DNA, also can be referred to as foreign nucleic acid, such as DNA. Thus, heterologous nucleic acid or foreign nucleic acid includes a nucleic acid molecule not present in the exact orientation or position as the counterpart nucleic acid molecule, such as DNA, is found in a genome. It also can refer to a nucleic acid molecule from another organism or species (i.e., exogenous).

Any nucleic acid, such as DNA, that one of skill in the art would recognize or consider as heterologous or foreign to the cell in which the nucleic acid is expressed is herein encompassed by heterologous nucleic acid; heterologous nucleic acid includes exogenously added nucleic acid that also is expressed endogenously. Examples of heterologous nucleic acid include, but are not limited to, nucleic acid that encodes traceable marker proteins, such as a protein that confers drug resistance, nucleic acid that encodes therapeutically effective substances, such as anti-cancer agents, enzymes and hormones, and nucleic acid, such as DNA, that encodes other types of proteins, such as antibodies. Antibodies that are encoded by heterologous nucleic acid can be secreted or expressed on the surface of the cell in which the heterologous nucleic acid has been introduced.

As used herein, "synthetic," with reference to, for example, a synthetic nucleic acid molecule or a synthetic gene or a synthetic peptide refers to a nucleic acid molecule or polypeptide molecule that is produced by recombinant methods and/or by chemical synthesis methods.

As used herein, "complementary DNA" or "cDNA" refers to synthetic DNA artificially synthesized from a messenger RNA (mRNA) template using the enzymes reverse transcriptase and DNA polymerase.

As used herein, "polypeptide" refers to two or more amino acids covalently joined. The terms "polypeptide" and "protein" are used interchangeably herein.

As used herein, a peptide refers to a polypeptide that is from 2 to 40 amino acids in length.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain). The amino acids that occur in the various sequences of amino acids provided herein are identified according to their known, three-letter or one-letter abbreviations (Table 1). The nucleotides which occur in the various nucleic acid fragments are designated with the standard single-letter designations used routinely in the art.

As used herein, "amino acid residue" refers to an amino acid formed upon chemical digestion (hydrolysis) of a polypeptide at its peptide linkages. The amino acid residues described herein are generally in the "L" isomeric form. Residues in the "D" isomeric form can be substituted for any L-amino acid residue, as long as the desired functional property is retained by the polypeptide. $NH_2$ refers to the free amino group present at the amino terminus of a polypeptide. COOH refers to the free carboxy group present at the carboxyl terminus of a polypeptide. In keeping with standard polypeptide nomenclature described in *J. Biol. Chem.*, 243: 3557-3559 (1969), and adopted 37 C.F.R. §§1.821-1.822, abbreviations for the amino acid residues are shown in Table 1:

TABLE 1

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | Proline |
| K | Lys | Lysine |
| H | His | Histidine |
| Q | Gln | Glutamine |
| E | Glu | Glutamic acid |
| Z | Glx | Glu and/or Gln |
| W | Trp | Tryptophan |
| R | Arg | Arginine |
| D | Asp | Aspartic acid |
| N | Asn | Asparagine |
| B | Asx | Asn and/or Asp |
| C | Cys | Cysteine |
| X | Xaa | Unknown or other |

All amino acid residue sequences represented herein by formulae have a left to right orientation in the conventional direction of amino-terminus to carboxyl-terminus. In addition, the phrase "amino acid residue" is broadly defined to include the amino acids listed in the Table of Correspondence (Table 1) and modified and unusual amino acids, such as those referred to in 37 C.F.R. §§1.821-1.822, and incorporated herein by reference. A dash at the beginning or end of an amino acid residue sequence indicates a peptide bond to a further sequence of one or more amino acid residues, to an amino-terminal group such as $NH_2$ or to a carboxyl-terminal group such as COOH.

As used herein, "naturally occurring amino acids" refer to the 20 L-amino acids that occur in polypeptides.

As used herein, "non-natural amino acid" refers to an organic compound containing an amino group and a carboxylic acid group that is not one of the naturally-occurring amino acids listed in Table 1. Non-naturally occurring amino acids thus include, for example, amino acids or analogs of amino acids other than the 20 naturally-occurring amino acids and include, but are not limited to, the D-stereoisomers of amino acids. Exemplary non-natural amino acids are known to those of skill in the art and can be included in a modified santalene synthase polypeptides provided herein. For example, exemplary non-natural amino acids are known to those of skill in the art, and include, but are not limited to, 2-Aminoadipic acid (Aad), 3-Aminoadipic acid (Baad), β-alanine/β-Amino-propionic acid (Bala), 2-Aminobutyric acid (Abu), 4-Aminobutyric acid/piperidinic acid (4Abu), 6-Aminocaproic acid (Acp), 2-Aminoheptanoic acid (Ahe), 2-Aminoisobutyric acid (Aib), 3-Aminoisobutyric acid (Baib), 2-Aminopimelic acid (Apm), 2,4-Diaminobutyric acid (Dbu), Desmosine (Des), 2,2'-Diaminopimelic acid (Dpm), 2,3-Diaminopropionic acid (Dpr), N-Ethylglycine (EtGly), N-Ethylasparagine (EtAsn), Hydroxylysine (Hyl), allo-Hydroxylysine (Rhyl), 3-Hydroxyproline (3Hyp), 4-Hydroxyproline (4Hyp), Isodesmosine (Ide), allo-Isoleucine (Aile), N-Methylglycine, sarcosine (MeGly), N-Methylisoleucine (MeIle), 6-N-Methyllysine (MeLys), N-Methylvaline (MeVal), Norvaline (Nva), Norleucine (Nle), and Ornithine (Orn).

Amino acid replacements or substitutions contemplated include conservative substitutions, including, but not limited to, those set forth in Table 2. Suitable conservative substitutions of amino acids are known to those of skill in the art and can be made generally without altering the conformation or activity of the polypeptide. Those of skill in the art recognize that, in general, single amino acid substitutions in non-essential regions of a polypeptide do not substantially alter biological activity (see, e.g., Watson et al. *Molecular Biology of the Gene,* 4th Edition, 1987, The Benjamin/Cummings Pub. co., p. 224). Conservative amino acid substitutions are made, for example, in accordance with those set forth in Table 2 as follows:

TABLE 2

| Original residue | Conservative substitution |
|---|---|
| Ala (A) | Gly; Ser; |
| Arg (R) | Lys; |
| Asn (N) | Gln; His |
| Cys (C) | Ser |
| Gln (Q) | Asn |
| Glu (E) | Asp |
| Gly (G) | Ala; Pro |
| His (H) | Asn; Gln |
| Ile (I) | Leu; Val |

TABLE 2-continued

| Original residue | Conservative substitution |
| --- | --- |
| Leu (L) | Ile; Val |
| Lys (K) | Arg; Gln; Glu |
| Met (M) | Leu; Tyr; Ile |
| Ornithine | Lys; Arg |
| Phe (F) | Met; Leu; Tyr |
| Ser (S) | Thr |
| Thr (T) | Ser |
| Trp (W) | Tyr |
| Tyr (Y) | Trp; Phe |
| Val (V) | Ile; Leu; |

Other conservative substitutions also are permissible and can be determined empirically or in accord with known conservative substitutions. The effects of such substitutions can be calculated using substitution score matrices such PAM120, PAM-200, and PAM-250 as discussed in Altschul (*J. Mol. Biol.* 219:55565 (1991)).

As used herein, a DNA construct is a single or double stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule cannot be paired. Such unpaired ends will, in general, not exceed 20 nucleotides in length.

As used herein, "primary sequence" refers to the sequence of amino acid residues in a polypeptide.

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

As used herein, the terms "homology" and "identity" are used to describe relatedness between and among polypeptides (or encoding nucleic acid molecules). Identity refers to identical sequences; homology can include conservative amino acid changes. In general, to identify corresponding positions, the sequences of amino acids are aligned so that the highest order match is obtained (see, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part I*, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; Carrillo et al. (1988) *SIAM J Applied Math* 48:1073).

As used herein, "sequence identity" refers to the number of identical or similar amino acids or nucleotide bases on a comparison between a test and a reference polypeptide or polynucleotide. Sequence identity can be determined by sequence alignment of nucleic acid or protein sequences to identify regions of similarity or identity. For purposes herein, sequence identity is generally determined by alignment to identify identical residues. The alignment can be local or global. Matches, mismatches and gaps can be identified between compared sequences. Gaps are null amino acids or nucleotides inserted between the residues of aligned sequences so that identical or similar characters are aligned. Generally, there can be internal and terminal gaps. When using gap penalties, sequence identity can be determined with no penalty for end gaps (e.g., terminal gaps are not penalized). Alternatively, sequence identity can be determined without taking into account gaps as the number of identical positions/length of the total aligned sequence×100.

For purposes herein, sequence identity can be determined by standard alignment algorithm programs used with default gap penalties established by each supplier. Default parameters for the GAP program can include: (1) a unary comparison matrix (containing a value of 1 for identities and 0 for non identities) and the weighted comparison matrix of Gribskov et al. *Nucl. Acids Res.* 14: 6745-6763 (1986), as described by Schwartz and Dayhoff, eds., *Atlas of Protein Sequence and Structure*, National Biomedical Research Foundation, pp. 353-358 (1978); (2) a penalty of 3.0 for each gap and an additional 0.10 penalty for each symbol in each gap; and (3) no penalty for end gaps. Whether any two nucleic acid molecules have nucleotide sequences or any two polypeptides have amino acid sequences that are at least 80%, 85%, 90%, 95%, 96%, 97%, 98% or 99% "identical," or other similar variations reciting a percent identity, can be determined using known computer algorithms based on local or global alignment (see e.g., wikipedia.org/wiki/Sequence_alignment_software, providing links to dozens of known and publicly available alignment databases and programs). Generally, for purposes herein, sequence identity is determined using computer algorithms based on global alignment, such as the Needleman-Wunsch Global Sequence Alignment tool available from NCBI/BLAST (blast.ncbi.nlm.nih.gov/Blast.cgi?CMD=Web&Page_TYPE=BlastHome); LAlign (William Pearson implementing the Huang and Miller algorithm (*Adv. Appl. Math.* (1991) 12:337-357)); and a program from Xiaoqui Huang available at deepc2.psilastate.edu/aat/align/align.html. Clustal analysis also can be used to align either nucleotide or protein sequences and to score their level of identity and similarity (available at ebi.ac.uk/Tools/msa/clusalw2/ or ebi.ac.uk/ebisearch/search.ebi?db=medline&t=clustal*). Typically, the full-length sequence of each of the compared polypeptides or nucleotides is aligned across the full-length of each sequence in a global alignment. Local alignment also can be used when the sequences being compared are substantially the same length.

As used herein, a "global alignment" is an alignment that aligns two sequences from beginning to end, aligning each letter in each sequence only once. An alignment is produced, regardless of whether or not there is similarity or identity between the sequences. For example, 50% sequence identity based on "global alignment" means that in an alignment of the full sequence of two compared sequences each of 100 nucleotides in length, 50% of the residues are the same. It is understood that global alignment also can be used in determining sequence identity even when the length of the aligned sequences is not the same. The differences in the terminal ends of the sequences will be taken into account in determining sequence identity, unless the "no penalty for end gaps" is selected. Generally, a global alignment is used on sequences that share significant similarity over most of their length. Exemplary algorithms for performing global alignment include the Needleman-Wunsch algorithm (Needleman et al. *J. Mol. Biol.* 48: 443-453 (1970)). Exemplary programs for performing global alignment are publicly available and include the Global Sequence Alignment Tool available at the National Center for Biotechnology Information (NCBI) website (ncbi.nlm.nih.gov/), and the program available at deepc2.psi.iastate.edu/aat/align/align.html.

As used herein, a "local alignment" is an alignment that aligns two sequence, but only aligns those portions of the sequences that share similarity or identity. Hence, a local alignment determines if sub-segments of one sequence are present in another sequence. If there is no similarity, no alignment will be returned. Local alignment algorithms include BLAST or Smith-Waterman algorithm (*Adv. Appl. Math.* 2(4): 482-489 (1981)). For example, 50% sequence identity based on "local alignment" means that in an alignment of the full sequence of two compared sequences of any length, a region of similarity or identity of 100 nucleotides in length has 50% of the residues that are the same in the region of similarity or identity.

Therefore, as used herein, the term "identity" represents a comparison or alignment between a test and a reference polypeptide or polynucleotide. In one non-limiting example, "at least 90% identical to" refers to percent identities from 90 to 100%, relative to the reference polypeptide or polynucleotide. Identity at a level of 90% or more is indicative of the fact that, assuming for exemplification purposes a test and reference polypeptide or polynucleotide length of 100 amino acids or nucleotides are compared, no more than 10% (i.e., 10 out of 100) of amino acids or nucleotides in the test polypeptide or polynucleotide differ from those of the reference polypeptide. Similar comparisons can be made between test and reference polynucleotides. Such differences can be represented as point mutations randomly distributed over the entire length of an amino acid sequence or they can be clustered in one or more locations of varying length up to the maximum allowable, e.g., 10/100 amino acid difference (approximately 90% identity). Differences also can be due to deletions or truncations of amino acid residues. Differences are defined as nucleic acid or amino acid substitutions, insertions or deletions. Depending on the length of the compared sequences, at the level of homologies or identities above about 85-90%, the result can be independent of the program and gap parameters set; such high levels of identity can be assessed readily, often without relying on software.

As used herein, it also is understood that the terms "substantially identical" or "similar" varies with the context as understood by those skilled in the relevant art, but that those of skill can assess such.

As used herein, an "aligned sequence" refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, "isolated" or "purified" polypeptide or protein or biologically-active portion thereof is substantially free of cellular material or other contaminating proteins from the cell or tissue from which the protein is derived, or substantially free from chemical precursors or other chemicals, when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as proteolytic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

The term "substantially free" of cellular material includes preparations of santalene synthase or terpene products in which the santalene synthase or terpene is separated from cellular components of the cells from which it is isolated or produced. In one embodiment, the term substantially free of cellular material includes preparations of santalene synthase or terpene products having less than about 30%, 20%, 10%, 5% or less (by dry weight) of non-santalene synthase or terpene proteins or products, including cell culture medium.

As used herein, production by recombinant methods by using recombinant DNA methods refers to the use of the well-known methods of molecular biology for expressing proteins encoded by cloned DNA.

As used herein, a "host cell" is a cell that is used to receive, maintain, reproduce and amplify a vector. A host cell also can be used to express the polypeptide encoded by the vector. The nucleic acid contained in the vector is replicated when the host cell divides, thereby amplifying the nucleic acids.

As used herein, "vector" (or "plasmid") refers to discrete DNA elements that are used to introduce heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as bacterial artificial chromosomes, yeast artificial chromosomes and mammalian artificial chromosomes. A vector also includes "virus vectors" or "viral vectors." Viral vectors are engineered viruses that are operatively linked to exogenous genes to transfer (as vehicles or shuttles) the exogenous genes into cells. Selection and use of such vehicles are well known to those of skill in the art.

As used herein, "expression" refers to the process by which nucleic acid is transcribed into mRNA and translated into peptides, polypeptides, or proteins. If the nucleic acid is derived from genomic DNA, expression can, if an appropriate eukaryotic host cell or organism is selected, include processing, such as splicing of the mRNA.

As used herein, an "expression vector" includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal, and the like. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, an "adenovirus" refers to any of a group of DNA-containing viruses that cause conjunctivitis and upper respiratory tract infections in humans.

As used herein, "naked DNA" refers to histone-free DNA that can be used for vaccines and gene therapy. Naked DNA is the genetic material that is passed from cell to cell during a gene transfer process called transformation or transfection. In transformation or transfection, purified or naked DNA that is taken up by the recipient cell will give the recipient cell a new characteristic or phenotype.

As used herein, operably or operatively-linked when referring to DNA segments means that the segments are arranged so that they function in concert for their intended purposes, e.g., transcription initiates in the promoter and proceeds through the coding segment to the terminator.

As used herein, a "chimeric protein" or "fusion protein" refers to a polypeptide operatively-linked to a different polypeptide. A chimeric or fusion protein provided herein can include one or more santalene synthase polypeptides, or a portion thereof, and one or more other polypeptides, for any one or more of transcriptional/translational control signals, signal sequences, a tag for localization, a tag for purification, part of a domain of an immunoglobulin G, and/or a targeting agent. A chimeric santalene synthase polypeptide also includes those having their endogenous domains or regions of the polypeptide exchanged with another polypeptide. These chimeric or fusion proteins include those produced by recombinant means as fusion proteins, those produced by chemical means, such as by chemical coupling, through, for example, coupling to sulfhydryl groups, and those produced by any other method whereby at least one polypeptide (i.e. santalene synthase), or a portion thereof, is linked, directly or indirectly via linker(s) to another polypeptide.

As used herein, recitation that a polypeptide "consists essentially" of a recited sequence of amino acids means that only the recited portion, or a fragment thereof, of the full-length polypeptide is present. The polypeptide can optionally, and generally will, include additional amino acids from another source or can be inserted into another polypeptide.

As used herein, a "composition" refers to any mixture. It can be a solution, suspension, liquid, powder, paste, aqueous, non-aqueous or any combination thereof.

As used herein, a "combination" refers to any association between or among two or more items. The combination can be two or more separate items, such as two compositions or two collections, can be a mixture thereof, such as a single mixture of the two or more items, or any variation thereof. The elements of a combination are generally functionally associated or related.

As used herein, a "kit" is a packaged combination that optionally includes other elements, such as additional reagents and instructions for use of the combination or elements thereof, for purposes including, but not limited to, production of terpene products, assessment of terpene production and/or assessment of another property or activity.

As used herein, the singular forms "a," "an" and "the" include plural referents unless the context clearly dictates otherwise. Thus, for example, reference to polypeptide, comprising "an amino acid replacement" includes polypeptides with one or a plurality of amino acid replacements.

As used herein, the term "or" is used to mean "and/or" unless explicitly indicated to refer to alternatives only, or the alternatives are mutually exclusive.

As used herein, ranges and amounts can be expressed as "about" a particular value or range. About also includes the exact amount. Hence "about 5%" means "about 5%" and also "5%."

As used herein, "optional" or "optionally" means that the subsequently described event or circumstance does or does not occur, and that the description includes instances where said event or circumstance occurs and instances where it does not. For example, an optional step of isolating santalene means that the santalene is isolated or is not isolated.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

B. Santalene Synthase and Production of Santalenes and Other Products

Provided herein are modified santalene synthases that exhibit improved or altered properties to produce sesquiterpene products as compared to wild type or unmodified santalene synthases. Santalene synthases are sesquiterpene synthases that have been identified in or isolated from various plant species, and that catalyze the biosynthetic formation of a mixture of santalenes and bergamotene (i.e., α-, β-, and epi-β-santalene and α-exo-bergamotene) In particular, santalene synthases have been identified in or isolated from various *Santalum* species, for example *Santalum album, Santalum austrocaledonicum, Santalum spicatum, Solanum habrochaites, Solanum lycopersicum, Santalum murrayanum, Clausena lansium* and others.

For example, santalene synthases have been identified in or isolated from *Santalum album*. Exemplary of a *Santalum album* santalene synthase (SaSSy) includes the 569 amino acid polypeptide having the amino acid sequence set forth in SEQ ID NO:1, and encoded by the sequence of nucleotides set forth in SEQ ID NO:2 (see e.g., U.S. Pat. Pub. No. 2012/0208173; and Jones et al. (2011) J. Biol. Chem. 286:17445-17454). Other known SaSSy sequences include the santalene synthase set forth in SEQ ID NO:258 that exhibits 99.82% sequence identity to SEQ ID NO:1 and is encoded by the sequence of nucleotides set forth in SEQ ID NO:239 (see e.g., U.S. Pat. No. 8,569,025); the santalene synthase set forth in SEQ ID NO:27 that exhibits 99.12% sequence identity to SEQ ID NO:1 and is encoded by the nucleic acid sequence set forth in SEQ ID NO:4 (see e.g., Genbank Accession No. ADP30867); the santalene synthase set forth in SEQ ID NO:28 that exhibits 98.95% sequence identity to SEQ ID NO:1 and is encoded by the nucleic acid sequence set forth in SEQ ID NO:5 (see e.g., U.S. Pat. Pub. No. 2011/0281257); the santalene synthase set forth in SEQ ID NO:29 that exhibits 92.62% sequence identity to SEQ ID NO:1 and is encoded by the nucleic acid sequence set forth in SEQ ID NO:6 (see e.g., U.S. Pat. Pub. No. 2011/0281257); and the santalene synthase set forth in SEQ ID NO:30 that exhibits 92.97% sequence identity to SEQ ID NO:1 and is encoded by the nucleic acid sequence set forth in SEQ ID NO:7 (see e.g., U.S. Pat. Pub. No. 2011/0281257).

*Santalum album* santalene synthases (SaSSy) also include those described in U.S. Pat. Pub. No. 2011/0281257 containing N-terminal truncations, such as the santalene synthase set forth in SEQ ID NO:31 (encoded by the nucleic acid sequence set forth in SEQ ID NO:8) and the santalene synthase set forth in SEQ ID NO:32 (encoded by the nucleic acid sequence set forth in SEQ ID NO:9). Additional santalene synthases include synthetic variants of *Santalum album* santalene synthase having amino acid sequences set forth in SEQ ID NOS:33-43 and encoded by the nucleic acid sequences set forth in SEQ ID NOS:16-26, respectively. An alignment of the various *S. album* santalene synthases is set forth in FIG. 2.

*Santalum* species santalene synthases also include santalene synthase from *Santalum spicatum* (SspiSSy, Genbank Accession No. HQ343278 or AD087002), which is a 569 amino acid polypeptide that has the amino acid sequence set forth in SEQ ID NO:10 that exhibits 94.55% sequence identity to SEQ ID NO:1 and is encoded by the nucleic acid sequence set forth in SEQ ID NO:11; santalene synthase from *Santalum austrocaledonicum* (SauSSy, Genbank Accession Nos. HQ343277 or AD087001), which is a 569 amino acid polypeptide with the amino acid sequence set forth in SEQ ID NO:12 that exhibits 98.59% sequence identity to SEQ ID NO:1 and is encoded by the nucleic acid sequence set forth in SEQ ID NO:13; and santalene synthase from *Santalum murrayanum* (SmSSy), which is a 569 amino acid polypeptide with the amino acid sequence set forth in SEQ ID NO:14 that exhibits 98.42% sequence identity to SEQ ID NO:1 and is encoded by the nucleic acid sequence set forth in SEQ ID NO:15 (see e.g., U.S. Pat. Pub. No. 2012/0208173 and Jones et al. (2011) J. Biol. Chem. 286: 17445-17454). Alignments of the *S. spicatum*, *S. austrocaledonicum* and *S. murrayanum* santalene synthases with the *S. album* santalene synthase set forth in SEQ ID NO:1 are set forth in FIGS. 3A-3C.

Santalene synthases have also been isolated from *Vetiver zitanoides* (vetiver; see e.g., International Pat. Pub. No. WO 2006/134523), *Solanum habrochaites* (tomato; see e.g., Sallaud et al. (2009) Plant Cell 21:301-317) and *Clausena lansium* (wampee; see e.g., U.S. Pat. Pub. No. 2011/0008836).

1. Santalene Synthase Function and Activity

Santalene synthases are members of an enzyme class known as terpene synthases, or terpene cyclases, that includes monoterpene synthases, sesquiterpene synthases, and diterpene synthases. Terpene synthases catalyze multi-step reactions converting diphosphorylated substrates of 10 (geranyl diphosphate (GPP)), 15 (farnesyl pyrophosphate (FPP), also called farnesyl diphosphate (FDP)), or 20 (geranylgeranyl diphosphate (GGPP)) carbons into acyclic and cyclic terpenes. The biosynthetic cyclization reactions proceed via electrophilic alkylation in which new carbon-carbon single bonds are formed through reaction of a highly reactive electron-deficient allylic carbocation and an electron-rich carbon-carbon double bond. The resulting terpenes can be isolated from a range of natural sources, including plants, fungi, bacteria, and invertebrates.

Santalene synthases are sesquiterpene synthases that are members of the class I terpene synthases, which are metal-dependent cyclases that convert linear, all-trans isoprenoid diphosphates, such as farnesyl diphosphate (FPP), into cyclic sesquiterpenes. Santalene synthases catalyze the biosynthetic formation of a mixture of santalenes and bergamotene (i.e., α-, β-, and epi-β-santalene and α-exo-bergamotene) from FPP (see e.g., WO 2011/000026 and Jones et al. (2011) J. Biol. Chem. 286:17445-17454). Specifically, santalene synthases catalyze the formation of α-santalene (1), β-santalene (2), epi-β-santalene (3), and α-exo-bergamotene (4, α-trans-bergamotene) from FPP (see FIGS. 1A and 1B).

The sesquiterpenes generated from FPP via santalene synthase, i.e., santalenes and bergamotene, can be oxidized to form sesquiterpenols, i.e., santalols and bergamotol. For example, cytochrome P450 oxidase polypeptide catalyzes the formation of one or more of α-santalol from α-santalene, β-santalol from β-santalene, epi-β-santalol from epi-β-santalene and/or α-exo-bergamotol from α-exo-bergamotene. Hydroxylation or monooxygenation of terpene substrates by the cytochrome P450 oxidase is generally performed in the presence of a cytochrome reductase. For example, the santalenes and bergamotene can be converted to santalols, such as α-santalols (5 and 6), β-santalols (7 and 8), epi-β-santalols (9 and 10); and bergamotols, such as α-exo-bergamotols (11 and 12, α-trans-bergamotols) (see FIGS. 1A and 1B), through a cytochrome P450 oxidase polypeptide-catalyzed reaction in the presence of a cytochrome reductase.

Santalene synthases are naturally found in plants, including in the heartwood of *Santalum* species, such as *Santalum album* (Indian Sandalwood, White Sandalwood, Chandan), *Santalum austrocaledonicum* (Australian Sandalwood), *Santalum spicatum*, *Solanum habrochaites* and *Solanum lycopersicum* (tomato), *Santalum murrayanum*, *Clausena lansium* (wampee) and others (see e.g., U.S. Pat. Pub. Nos. 2011/0281257 and 2012/0208173; and Jones et al. (2011) J. Biol. Chem. 286:17445-17454).

In particular, the santalols and bergamotol are natural constituents of sandalwood oil, an essential oil found in sandalwood trees. Sandalwood (*Santalum album*) is a slow-growing, hemi-parasitic, tropical tree with great economic value that can be found growing in southern India, Sri Lanka, eastern Indonesia and northern Australia. The timber is highly sought after for its fine grain, high density and excellent carving properties. Sandalwood heartwood has a unique fragrance imparted by the resins and essential oils, which include santalols, santalenes and other sesquiterpenoids. In general, *Santalum album* heartwood contains up to 6% dry weight sesquiterpene oils. Sandalwood oil is highly valued and has been obtained by distillation of the heartwood of *Santalum* species. Sandalwood oil predominantly contains the sesquiterpene alcohols α-santalol, β-santalol, epi-β-santalol, and Z-α-trans-bergamotol, and additionally includes α-santalene, β-santalene, epi-β-santalene, α-bergamotene, β-bisabolene, α-curcumene, β-curcumene and γ-curcumene. Sandalwood oil has been used in the perfume industry as a perfume ingredient because of the soft, sweet-woody and animal-balsamic odor, imparted from the terpenoid β-santalol, and has also been used in incenses, in traditional medicine, and in pesticides.

Santalenes and bergamotenes also can be produced biosynthetically from farnesyl pyrophosphate (FPP) by santalene synthase (see, U.S. Pat. Pub. No. 2012/0208173 and Jones et al. (2011) *J Biol Chem* 286:17445-17454). The pathways for biosynthesis of santalenes and bergamotenes can also be metabolically engineered in host cells by transforming heterologous nucleic acid encoding a santalene synthase into a host cell (e.g., yeast cell). The host cells also can be engineered to produce santalols and bergamotols, components of sandalwood oil, by co-transforming nucleic acid encoding a cytochrome P450 oxidase and cytochrome P450 reductase in combination with a nucleic acid molecule encoding a santalene synthase (see e.g., Diaz-Chavez et al. (2013) *PLoS One,* 8:1-11).

2. Structure of Santalene Synthases

Sesquiterpene synthases, for example, santalene synthases, generally range from about 550 to 580 amino acids in length. For example, the sesquiterpene synthase santalene synthase is 569 amino acids in length. Although sequence identity between and among terpene synthases is not generally high, the terpene synthase (Tps) gene family of plant terpene synthases is subdivided into seven subfamilies based on amino acid sequence relatedness, designated TPS-a, TPS-b, TPS-c, TPS-d, TPS-e/f, TPS-g, and TPS-h (Chen et al. (2011) Plant J. 66:212-229). Santalene synthases, such as those isolated from sandalwood species, e.g., SaSSy, SauSSy, and SspiSSy, are phylogenetically aligned with the TPS-b subfamily. Santalene synthases (e.g., SaSSy) share many of the motifs and structural elements common to other sesquiterpene synthases, and, in particular, those of the TPS-b subfamily. For example, the catalytic domain of santalene synthase shares a common 3-dimensional structure with other terpene synthases (described in, for example, U.S. Pat. Nos. 6,465,772; 6,495,354; and 6,559,297).

Despite the lack of significant amino acid sequence relationships, based on the crystal structures of several sesquiterpene synthases and modeling studies, the three-dimensional structures of sesquiterpene synthases share a common, α-helical "terpene synthase fold." Generally, the synthases contain alpha helices interconnected by short connecting loops and turns (Starks et al. (1997) Science 277:1815-1820; Lesburg et al. (1997) Science 277:1820-1824; see Table 3). For example, the crystal structure for tobacco epi-aristolochene synthase and bornyl diphosphate synthase show the proteins to have a two-layer α-barrel active site, composed entirely of α-helices with short, connecting loops and turns. Thus, like other terpene synthases, santalene synthases contain an N-terminal domain and a C-terminal catalytic domain, that each separately form a compact α-helical domain to result in two α-helical domains. The N-terminal domain of plant terpene synthases has structural similarity with some glycosylhydrolases, but the exact function of the domain is not precisely known. Evidence from mutational analyses, however, suggests that this domain plays a role in folding by acting as a scaffold in order to facilitate proper folding of the C-terminal domain. The C-terminal domain contains the active site cavity (Degenhardt et al. (2009) Phytochem. 70:1621-1637; Wymore et al. (2011) Mol. Inf. 30:896-906).

In general, terpene synthases, for example, sesquiterpene synthases, e.g., santalene synthases, contain large active sites that allow the binding and folding of the substrate, the generation and stabilization of high-energy carbocations, and acidic/basic catalysis to dictate specific skeletal and metabolic fates. In sesquiterpene synthases, the enzyme active site is a large, hydrophobic pocket in the C-terminal domain formed by six α-helices (C, D, F, G, H and J) and closed off towards the outside by two loops that are located on the protein surface. The active site is lined by aromatic residues that serve to stabilize carbocation intermediates through cation-π interactions. The aromatic residues involved in the metal coordination reactions are largely conserved among all terpene synthases, such as among all sesquiterpene synthases (Bohlmann et al. (1998) Proc. Natl. Acad. Sci. U.S.A. 95:4126-4133; Whittington et al. (2002) Proc. Natl. Acad. Sci. U.S.A. 99(24):15375-15380; Degenhardt et al. (2009) Phytochem. 70:1621-1637; Li et al. (2013) Biochem. J. 451:417-426).

The catalytic site contains a large central cavity formed by mostly antiparallel alpha helices with two conserved metal binding sites, i.e. aspartate-rich regions, located on opposite walls. These two conserved metal binding motifs coordinate the binding of three $Mg^{2+}$ ions to the isoprenoid disphosphate substrate. Aspartate-rich region 1 is located on helix D and is characterized by a conserved DDxxD motif. The DDxxD motif is almost perfectly conserved in plant terpene synthases, particularly the pyrophosphate-utilizing enzymes, and directs substrate binding via formation of complexes with divalent metal ions, e.g., magnesium or manganese, by forming salt bridges between substrate phosphate groups and the aspartate residues. For example, the Asp-Asp pair is involved in chelating the essential $Mg^{2+}$ ions, which in turn chelates the pyrophosphate ions. The location at the entrance of the catalytic site is involved in positioning the substrate for catalysis (Degenhardt et al. (2009) Phytochem. 70:1621-1637; Rani et al. (2013) Gene 527:642-648). In SaSSy, the DDxxD motif corresponds to amino acid residues 321-325 with reference to SEQ ID NO:1. Asp321 and Asp 325 of aspartate-rich region 1 mediate binding of the substrate diphosphate moieties (i.e., farnesyl diphosphate) through coordination with bridging $Mg^{2+}$ ions.

Aspartate-rich region 2 is located on Helix H and is characterized by the conserved sequence [N/D]xxx[S/T]xxxE (SEQ ID NO:173), which corresponds to amino acids N463, D464, I465, G466, T467, S468, P469, D470 and E471 of SEQ ID NO:1. This region binds an additional $Mg^{2+}$ ion through amino acids Asn463, Thr467 and Glu471. Subsequent binding of the farnesyl diphosphate substrate induces conformational changes such that the N-terminal region forms a cap over the catalytic core that closes the active site to solvent, thereby stabilizing the reactive carbocation intermediates.

Another highly conserved region in terpene synthases, for example, sesquiterpene synthases, e.g., santalene synthases, is the N-terminal, arginine-rich motif $RRX_8W$, or $R(R/P)X_8W$ (SEQ ID NO:291). In SaSSy, this motif corresponds to amino acid residues 32-42 of SEQ ID NO:1. This motif contains a tandem RR (e.g., at positions 32 and 33 of SEQ ID NO:1), that has been shown to be involved in monoterpene cyclization but is generally absent in monoterpene synthases that produce only acyclic compounds (Williams et al. ((1998) *Biochemistry,* 37:12213-20). Truncation of residues up to the tandem arginines has been shown to result in a fully active pseudomature synthase, demonstrating that in some synthases these N-terminal residues are not required for activity.

C. Modified Santalene Synthase Polypeptides and Encoding Nucleic Acid Molecules Provided herein are modified santalene synthase polypeptides. Also provided herein are nucleic acids that encode any of the modified santalene synthase polypeptides provided herein. In particular, the modifications provided herein effect increased terpene production and/or an altered terpene product profile compared to the santalene synthase not containing the modification(s), such as the santalene synthase set forth in SEQ ID NO:1 encoded by the sequence of nucleotides set forth in SEQ ID NO:2 or SEQ ID NO:3. Although various santalene synthases are known in the prior art, including santalene synthases engineered to contain modification(s) (see e.g., SEQ ID NOS: 33-43 engineered to contain an amino acid replacement, or SEQ ID NOS: 31 or 32 that contain an altered N-terminus), the prior art does not describe any modified santalene synthases that exhibit increased terpene production and/or an altered product profile compared to the santalene synthase not containing the modification(s), such as the santalene synthase set forth in SEQ ID NO:1 and encoded by the sequence of nucleotides set forth in SEQ ID NO:2 or SEQ ID NO:3. Thus, the modified santalene synthase polypeptides, and encoding nucleic acid molecules, described herein exhibit properties to effect increased terpene production and/or an altered terpene product profile, and thereby are improved compared to other known santalene synthase polypeptides.

The modifications described herein (i.e. changes in amino acid or nucleotide sequence) can be with reference to any santalene synthase polypeptide (i.e. unmodified santalene synthase). Typically, modifications are in a *Santalum* species santalene synthase. In general, modifications described herein are in the santalene synthase set forth in SEQ ID NO:1, or a catalytically active fragment thereof. It is understood, however, that santalene species exhibit a high degree of sequence identity that is greater than 93% between and among different santalene species. For example, the *Santalum* species santalene synthases from *Santalum spicatum* (SspiSSy; set forth in SEQ ID NO:10), *Santalum austrocaledocium* (SauSSy; set forth in SEQ ID NO:12) and *Santalum murrayanum* (SmSSy; set forth in SEQ ID NO:14) exhibit greater than 94% or more sequence identity to the santalene species *Santalum album* (SaSSy) set forth in SEQ ID NO:1. In addition, a number of variants of santalene synthase from *Santalum album* also have been isolated and are known, such as variants set forth in SEQ ID NOS:27, 28, 29, 30 and 258 or other variants set forth in any of SEQ ID NOS: 31-43.

Thus, any of the modifications described herein with reference to SaSSy set forth in SEQ ID NO:1 can be made in another santalene synthase. For example, the modifications described herein can be in a santalene synthase as set forth in any of SEQ ID NOS:1, 10, 12, 14, 27-43 or 258, catalytically active fragments thereof, or any variant thereof that has at least 60%, 70%, 80%, 85%, 86%, 87%, 88%, 89%, 90%, 91%, 92%, 93%, 94%, 95%, 96%, 97%, 98%, or 99% sequence identity to a santalene synthase polypeptide set forth in any of SEQ ID NOS:1, 10, 12, 14, 27-43 or 258 or a catalytically active fragment thereof. In particular, provided herein are modified *Santalum album* santalene synthase polypeptides that contain one or more modifications compared to a santalene synthase set forth in any of SEQ ID NOS:1, 27, 28, 31, 33-43 or 258, a catalytically active fragment thereof, or any variant thereof that has at least 60%, 70%, 80%, 85%, 86%, 87%, 88%, 89%, 90%, 91%, 92%, 93%, 94%, 95%, 96%, 97%, 98%, or 99% sequence identity to a santalene synthase polypeptide set forth in any of SEQ ID NOS:1, 27, 28, 31, 33-43 or 258 or a catalytically active fragment thereof.

The modified santalene synthase polypeptides provided herein exhibit activity to catalyze the formation of terpene products (e.g., α-santalene, β-santalene, epi-beta-santalene, α-exo-bergamotene and/or other terpenes) from any suitable acyclic pyrophosphate terpene precursor, including, but not limited to, farnesyl diphosphate (FPP), geranyl diphosphate (GPP) and geranylgeranyl diphosphate (GGPP). Typically, the modified santalene synthases catalyze the formation of α-santalene, β-santalene, epi-beta-santalene and/or α-exo-bergamotene from FPP. The modified santalene synthase polypeptides can exhibit 50% to 500%, such as 50% to 120%, 100% to 500%, or 110% to 250% of the total terpene production (e.g., α-santalene, β-santalene, epi-beta-santalene and/or α-exo-bergamotene) from FPP compared to the santalene synthase polypeptide not containing the modification(s) (i.e. the unmodified santalene synthase), such as the santalene synthase encoded by the sequence of nucleotides set forth in SEQ ID NO:2 or encoded by the codon-optimized variant thereof set forth in SEQ ID NO:3. The terpene products can be produced in vitro or in vivo. For example, the terpene products can be produced in a host cell that produces FPP.

The modified santalene synthases provided herein also produce one or more terpene products of the santalene synthase polypeptide not containing the modifications. The profile of a santalene synthase can be represented as the percentage or ratio of the amount of each terpene product produced compared to the total amount of terpene products produced. For example, as a total percentage of terpene products produced from FPP (i.e. totaling 100% of total terpene products), the modified santalene synthase polypeptides can produce 2% to 70% α-santalene, 1% to 50% β-santalene, 5% to 99% α-exo-bergamotene and/or 0 to 10% of other terpene products (e.g., epi-β-santalene, (E)-β-farnesene, and (Z)-β-farnesene). The modified santalene synthases provided herein can exhibit activity to produce a product profile of terpene products from FPP containing one or more terpene products α-santalene, β-santalene, epi-beta-santalene and/or α-exo-bergamotene. For example, as a total percentage of terpene products produced from FPP (i.e. totaling 100% of total terpene products), the modified santalene synthase polypeptides can produce 2% to 70% α-santalene, 1% to 50% β-santalene, 5% to 99% α-exo-bergamotene and/or 1 to 10% of epi-β-santalene. Generally, the modified santalene synthases provided herein principally exhibit activity to produce a product profile of terpene products from FPP containing one or more, two or more or all three of the major terpene products α-santalene, β-santalene and/or α-exo-bergamotene.

Typically, wild type SaSSy produces the three major products as a total percentage of terpene products that is in the range of or about 45 to 50% α-santalene, 25% to 30% β-santalene, and 25 to 30% α-exo-bergamotene. Further, it is found herein that the profile of products produced from SaSSy encoded by the codon-optimized variant having the sequence of nucleotides set forth in SEQ ID NO:3 is statistically altered compared to the profile of products produced from SaSSy encoded by wild type SaSSy having the sequence of nucleotides set forth in SEQ ID NO:2. For example, codon-optimized SaSSy set forth in SEQ ID NO:3, when expressed in cells, can result in an altered product profile to produce α-santalene and β-santalene as a combined percentage of the total percentage of terpene products produced that is decreased by up to three percent compared to the amount of α-santalene and β-santalene produced as a combined percentage of the total percentage of terpene products from SaSSy when expressed from the nucleic acid molecule set forth in SEQ ID NO:2 (see Example 2). For example, as shown in the Examples, in an average of 27 experiments, codon-optimized SaSSy set forth in SEQ ID NO:3, when expressed in cells, produces the three major products as a total percentage of terpene products that is 45.7%±1.03 α-santalene, 26.12%±0.64 β-santalene and 30.40%±1.43 α-exo-bergamotene. Further, it is found herein that particular modification(s) also can further alter the product profile distribution.

Typically, the modified santalene synthase polypeptides provided exhibit increased production of terpene products (e.g., α-santalene, β-santalene, epi-β-santalene and/or α-exo-bergamotene) and/or an altered product profile of terpene products (e.g., α-santalene, β-santalene, epi-β-santalene and/or α-exo-bergamotene) compared to the santalene synthase polypeptide not containing the modification(s) (i.e. the unmodified santalene synthase), such as the santalene synthase encoded by the sequence of nucleotides set forth in SEQ ID NO:2 or the codon-optimized variant thereof set forth in SEQ ID NO:3. Exemplary of such modified santalene synthase polypeptides are described herein and exemplified in the Examples.

For example, the modified santalene synthase polypeptides provided herein exhibit increased production of terpene products (e.g., α-santalene, β-santalene, epi-β-santalene and/or α-exo-bergamotene) from FPP compared to the santalene synthase polypeptide not containing the modification(s) (i.e. the unmodified santalene synthase polypeptide), such as the santalene synthase encoded by the sequence of nucleotides set forth in SEQ ID NO:2 or the codon-optimized variant thereof set forth in SEQ ID NO:3. For example, the modified santalene synthase polypeptide can catalyze the formation of terpene products (e.g., α-santalene, β-santalene, epi-β-santalene and/or α-exo-bergamotene) from FPP in a host cell in an amount that is greater than the amount of total terpene products (e.g., α-santalene, β-santalene, epi-β-santalene and/or α-exo-bergamotene) produced from FPP in a host cell expressing the nucleic acid molecule set forth in SEQ ID NO:2. In some cases, the modified santalene synthase polypeptide can catalyze the formation of terpene products (e.g., α-santalene, β-santalene, epi-β-santalene and/or α-exo-bergamotene) from FPP in a host cell in an amount that is greater than the amount of total terpene products (e.g., α-santalene, β-santalene, epi-β-santalene and/or α-exo-bergamotene) produced from FPP in a host cell expressing the nucleic acid molecule set forth in SEQ ID NO:3.

In such examples, the amount of total terpene products (e.g., α-santalene, β-santalene, epi-β-santalene and/or α-exo-bergamotene) produced from FPP by a modified santalene synthase provided herein is an amount that is at least or about at least 105%, 106%, 107%, 108%, 109%, 110%, 115%, 120%, 125%, 130%, 135%, 140%, 145%, 150%, 160%, 170%, 180%, 200%, 250%, 300%, 350%, 400%, 500% or more of the amount of total terpene products produced from FPP by the santalene synthase polypeptide not containing modification(s) (i.e. the unmodified santalene synthase), such as the santalene synthase encoded by the sequence of nucleotides set forth in SEQ ID NO:2 or the codon-optimized variant thereof set forth in SEQ ID NO:3. For example, the total terpene production (e.g., α-santalene, β-santalene, epi-β-santalene and/or α-exo-bergamotene) is increased at least or about at least 1.2-fold, 1.5-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 25-fold, 30-fold, 40-fold, 50-fold, 60-fold, 70-fold, 80-fold, 90-fold, 100-fold, 200-fold, 300-fold, 400-fold or more.

Alternatively, or in addition, modified santalene synthase polypeptides provided herein exhibit an altered product profile or an altered product distribution of one or more santalene terpene products (e.g., α-santalene, β-santalene and/or epi-β-santalene) and/or α-exo-bergamotene from FPP compared to the santalene synthase polypeptide not containing the modification(s) (i.e. the unmodified santalene synthase), such as the santalene synthase encoded by the sequence of nucleotides set forth in SEQ ID NO:2 or the codon-optimized variant thereof set forth in SEQ ID NO:3. In particular, the modified santalene synthase polypeptides exhibit an altered profile or distribution of the major terpene products α-santalene, β-santalene, and/or α-exo-bergamotene. For example, the modified santalene synthase polypeptides provided herein can catalyze the formation of terpene products (e.g., α-santalene, β-santalene, epi-β-santalene and/or α-exo-bergamotene) from FPP in a host cell to result in an altered product profile, whereby at least one terpene product is altered (increased or decreased) in the product profile by at least 1%, 2%, 3%, 4%, 5%, 6%, 7%, 8%, 9%, 10%, 15%, 20%, 25%, 30%, 35%, 40%, 50%, 60%, 70%, 80%, 90% or more compared to same product produced in a host cell from FPP by the santalene synthase not containing the modification(s), such as the santalene synthase encoded by the sequence of nucleotides set forth in SEQ ID NO:2 or the codon-optimized variant thereof set forth in SEQ ID NO:3. For example, the product profile is altered (e.g., increased or decreased) compared to the santalene synthase encoded by the sequence of nucleotides of the codon-optimized variant set forth in SEQ ID NO:3. In some cases, at least two of the major terpene products or all three of the major terpene products, i.e. α-santalene, β-santalene, and α-exo-bergamotene, are altered (increased or decreased) in the product profile of a modified santalene synthase provided herein.

For example, the amount of at least one terpene product (e.g., α-santalene, β-santalene, epi-β-santalene or α-exo-bergamotene) produced from FPP by a modified santalene synthase provided herein is at least or about at least 98% or less, such as less than 97%, 95%, 90%, 85%, 80%, 75%, 70%, 65%, 60%, 55%, 50%, 45%, 40%, 35%, 30%, 25%, 20%, 15%, 10%, 5% or less of the amount of the same terpene product produced from FPP by the santalene synthase encoded by the sequence of nucleotides set forth in SEQ ID NO:2 or the codon-optimized variant thereof set forth in SEQ ID NO:3. In another example, the amount of at least one terpene product (e.g., α-santalene, β-santalene, epi-β-santalene and/or α-exo-bergamotene) produced from FPP by a modified santalene synthase provided herein is at least or about at least 102% or greater, such as greater than 103%, 104%, 105%, 106%, 107%, 108%, 109%, 110%, 115%, 120%, 130%, 140%, 150%, 160%, 170%, 180%, 190%, 200%, 210%, 220%, 230%, 240%, 250%, 260%, 270%, 280%, 290%, 300%, 310%, 320%, 330%, 340%, 350%, 400%, 500% or more of the amount of the same terpene product produced from FPP by the santalene synthase encoded by the sequence of nucleotides set forth in SEQ ID NO:2 or the codon-optimized variant thereof set forth in SEQ ID NO:3.

Exemplary modifications in a modified santalene synthase provided herein are described in further detail below. In particular, the modified santalene synthase polypeptides provided herein contain amino acid replacements (i.e. substitutions), additions (i.e. insertions), deletions, truncations or combinations thereof. The modifications can be made in any region or domain of a santalene synthase provided the resulting modified santalene synthase at least retains catalytic activity (i.e. the ability to catalyze the formation of α-santalene, β-santalene, epi-β-santalene and/or α-exo-bergamotene from an acyclic pyrophosphate terpene precursor, typically FPP). Non-limiting modifications are described in the subsections below, which include amino acid replacements, deletions, or swaps of a domain or region with a corresponding domain or region from another synthase. For example, entire or partial domains or regions, such as any domain or region described herein below, are exchanged with a corresponding heterologous domain or region or portions thereof from another terpene synthase.

To retain santalene synthase activity, modifications typically are not at those positions that are less tolerant to change. Such positions can be within domains or regions that are required for catalysis of santalenes or bergamotene from FPP and/or substrate binding. For example, such positions include regions that are highly conserved, such as the metal-binding aspartate-rich motifs (DDxxD). A skilled artisan knows or can readily identify amino acid residues that are required for activity and should not be changed. Also, in some instances if a modification is at these positions, it generally is a conservative amino acid substitution. One of skill in the art understands conservative amino acid substitutions, such as those provided in Table 2, can be used to reduce the likelihood of a modification resulting in a reduction in activity, such as a reduction in the amount of santalenes or bergamotene produced from FPP compared to wild-type santalene synthase.

For example, modified santalene synthase polypeptides provided herein can contain at least, up to, or 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 90, 95, 100, 105, 110, 115, 120 or more modified amino acid positions compared to the santalene synthase polypeptide not containing the modification.

The modified santalene synthases provided herein generally exhibit at least 70% amino acid sequence identity to the santalene synthase polypeptide set forth in any of SEQ ID NO:1, 10, 12, 14, 27-43 or 258 or a catalytically active fragment thereof, and typically at least 70% amino acid sequence identity to SEQ ID NO:1 or a catalytically active fragment thereof. For example, the modified santalene synthase polypeptides provided herein generally exhibit at least or at least about 75%, 80%, 81%, 82%, 83%, 84%, 85%, 86%, 87%, 88%, 89%, 90%, 91%, 92%, 93%, 95%, 95%, 96%, 97%, 98% or 99% amino acid sequence identity to the santalene synthase set forth in any of SEQ ID NO:1, 10, 12, 14, 27-43 or 258 or a catalytically active fragment thereof. In particular, the modified santalene synthase polypeptides provided herein generally exhibit at least or at least about 75%, 80%, 81%, 82%, 83%, 84%, 85%, 86%, 87%, 88%, 89%, 90%, 91%, 92%, 93%, 95%, 95%, 96%, 97%, 98% or 99% amino acid sequence identity to the santalene synthase set forth in SEQ ID NO:1 or a catalytically active fragment thereof. It is within the level of a skilled artisan to determine the percent identity of a first sequence to a second sequence using standard alignment programs. Typically, alignment is determined based on global alignment, which aligns the full length of each sequence to each other. For example, as can be determined by one of skill in the art using standard alignment programs, a modified santalene synthase polypeptide containing 19 amino acid replacements (e.g., the modified santalene synthase named SaSSy-2 set forth in SEQ ID NO:132 as described below) exhibits about 96.7% homology to the santalene synthase set forth in SEQ ID NO:1.

As indicated, also provided herein are nucleic acid molecules that encode any of the modified santalene synthase polypeptides provided herein. Hence, a modified nucleic acid molecule that encodes any of the modified santalene synthases provided herein includes codon changes corresponding to modifications provided herein (e.g., replacement or substitution, insertion or addition, or deletion of one or more nucleotides). It is within the level of a skilled artisan, who is familiar with codons that correspond to various amino acids, to identify such codon changes based on exemplification of the modified amino acids herein. Exemplary codon changes corresponding to modified amino acid residues are set forth in Tables 7 and 8 for exemplary variants described herein.

Hence, modified nucleic acid molecules encoding a modified santalene synthase provided herein can contain modifications (i.e. nucleotide changes) with reference to the corresponding nucleic acid molecule encoding the unmodified santalene synthase, such as a *Santalum* species santalene synthase. For example, the modifications can be in a nucleic acid molecule set forth in any of SEQ ID NOS: 2, 4-9, 11, 13, 15-26 or 239, a degenerate sequence thereof, or a portion thereof that encodes a catalytically active santalene synthase, or in a variant thereof that exhibits at least 60%, 70%, 80%, 85%, 86%, 87%, 88%, 89%, 90%, 91%, 92%, 93%, 94%, 95%, 96%, 97%, 98%, or 99% identity to the nucleic acid molecule set forth in any of SEQ ID NOS: 2, 4-9, 11, 13, 15-26 or 239, a degenerate thereof or a portion thereof that encodes an active santalene synthase. In particular, the modifications are in a nucleic acid molecule encoding a *Santalum album* santalene synthase polypeptide, such as in a nucleic acid molecule set forth in any of SEQ ID NOS: 2, 4, 5, 8, 16-26 or 239, a degenerate thereof, a portion thereof that encodes a catalytically active santalene synthase, or in a variant thereof that exhibits at least 60%, 70%, 80%, 85%, 86%, 87%, 88%, 89%, 90%, 91%, 92%, 93%, 94%, 95%, 96%, 97%, 98%, or 99% identity to the nucleic acid molecule set forth in any of SEQ ID NOS: 2, 4, 5, 8, 16-26 or 239, a degenerate thereof or a portion thereof that encodes a catalytically active santalene synthase. For example, the modifications are in a nucleic acid molecule set forth in SEQ ID NO:2 or a portion thereof encoding an active santalene synthase.

In particular examples, the nucleic acid sequence can be codon optimized, for example, to increase expression levels of the encoded sequence. The particular codon usage is dependent on the host organism in which the modified polypeptide is expressed. One of skill in the art is familiar with optimal codons for expression in mammalian or human cells, bacteria or yeast, including for example *E. coli* or *Saccharomyces cerevisiae*. For example, codon usage information is available from the Codon Usage Database available at kazusa.or.jp.codon (see e.g., Richmond (2000) *Genome Biology*, 1:241 for a description of the database. See also, Forsburg (2004) *Yeast,* 10:1045-1047; Brown et al. (1991) *Nucleic Acids Research,* 19:4298; Sharp et al. (1988) *Nucleic Acids Res.,* 12:8207-8211; Sharp et al. (1991) *Yeast,* 657-78). Exemplary of a codon-optimized santalene synthase is set forth in SEQ ID NO:3, which encodes SaSSy having the sequence of amino acids set forth in SEQ ID NO:1. Another exemplary codon-optimized santalene synthase is set forth in SEQ ID NO:44, which encodes SspiSSy having the sequence of amino acids set forth in SEQ ID NO:10. Thus, corresponding nucleotide modifications herein can be in a nucleic acid molecule set forth in SEQ ID NO:3 or SEQ ID NO:44, or in a portion thereof encoding an active santalene synthase polypeptide. In particular, corresponding nucleotide modifications provided herein are in the sequence of nucleotides set forth in SEQ ID NO:3 or a portion thereof encoding a catalytically active santalene synthase polypeptide.

Exemplary non-limiting modifications (e.g., amino acid replacements) are described below in the following subsections. For purposes herein, reference to positions and amino acids for modification, including amino acid replacements, herein are by SaSSy numbering with reference to the santalene synthase set forth in SEQ ID NO:1. It is within the level of one of skill in the art to make corresponding modifications in santalene synthase polypeptides, such as any set forth in SEQ ID NOS: 1, 10, 12, 14, 27-43 or 258 or any variant thereof. Amino acid modifications can be made at corresponding residues of any santalene synthase polypeptide by alignment with the santalene synthase polypeptide set forth in SEQ ID NO:1 (see e.g., FIGS. 2 and 3). For example, FIGS. 2A-F and FIGS. 3A-C depicts SaSSy numbering and corresponding positions between and among exemplary santalene synthase polypeptides.

For purposes herein, amino acid replacements are denoted by the replaced amino acid, the amino acid position and the replacing amino acid (e.g., T5 S, which represents that the amino acid at a position corresponding to amino acid residue 5 in SEQ ID NO:1, e.g., threonine, is replaced by serine). Nomenclature also is employed herein to represent the insertion (---→followed by position of insertion) or deletion (e.g., position of deletion followed by→---) of an amino acid residue at a corresponding position in SEQ ID NO:1. For example, M1→--- means that the residue at a position corresponding to position 1 of SEQ ID NO:1 is deleted. Also, ---→C119 means that the residue at position 119 is inserted compared to the corresponding sequence set forth in SEQ ID NO:1.

In some cases, due to deletions or insertions of amino acid residues (e.g., N-terminal deletion or swap variants described herein), the numbering of residues in a modified santalene synthase is altered compared to the numbering of residues set forth in SEQ ID NO:1. In such instances, nomenclature is used herein, including in the Examples, to identify residues in the corresponding modified santalene synthase that correspond to residues in SEQ ID NO:1. As indicated above, the residue number of the corresponding position in the modified santalene synthase can be identified by alignment with the sequence of amino acids set forth in SEQ ID NO:1. As an example, reference to G119→N120 refers to the amino acid replacement G119N (i.e. that glycine corresponding to position 119 in SEQ ID NO:1 is replaced by asparagine), but indicates that the position in the modified santalene synthase that corresponds to this replacement is position 120.

Based on this description, it is within the level of one of skill in the art to generate a santalene synthase containing any one or more of the described mutation(s), and test each for santalene synthase activity and/or product profile, as described herein.

1. Exemplary Modifications
a. Codon-Optimization

Provided herein are santalene synthase polypeptides that are encoded by a nucleic acid molecule modified for codon optimization, and the encoding codon-optimized nucleic acid molecule. It is found herein that codon-optimization of nucleotides encoding a santalene synthase results in increased terpene production and an altered product profile compared to a corresponding santalene synthase that is encoded by a wild type or native santalene synthase sequence that has not been codon-optimized. For example, provided herein are codon-optimized variants encoding a santalene synthase that catalyze at least 105%, 106%, 107%, 108%, 109%, 110%, 111%, 112%, 113%, 114%, 115%, 120%, 125%, 130%, 135%, 140%, 145%, 150%, or more of the amount of total terpene products (e.g., α-santalene, β-santalene, epi-β-santalene and/or α-exo-bergamotene) produced from FPP compared to the corresponding santalene synthase polypeptide encoded by a sequence of nucleotides that has not been codon-optimized. Alternatively or additionally, provided herein are codon-optimized variants encoding a santalene synthase that produce an altered product profile to result in production of at least one terpene product (e.g., α-santalene, β-santalene, epi-β-santalene and/or α-exo-bergamotene) whose production profile is altered (increased or decreased) by at least 1%, 2%, 3%, 4%, 5%, 6%, 7%, 8%, 9%, 10% or more compared to same product produced in a host cell from FPP by the corresponding santalene synthase encoded by a sequence of nucleotides that has not been codon-optimized.

The codon-optimization can be effected based on the particular expression system utilized for expression of the synthase and production of terpene products. In particular, the codon-optimization utilizes codons that facilitate expression in yeast, such as in *Saccharomyces cerevisiae*. The encoded santalene synthase can be a synthase set forth in any of SEQ ID NOS: 1, 10, 12, 14, 27-43 or 258, catalytically active fragments thereof, or any variant thereof that has at least 60%, 70%, 80%, 85%, 86%, 87%, 88%, 89%, 90%, 91%, 92%, 93%, 94%, 95%, 96%, 97%, 98%, or 99% sequence identity to a santalene synthase polypeptide set forth in any of SEQ ID NOS:1, 10, 12, 14, 27-43 or 258 or a catalytically active fragment thereof. In particular, the codon-optimized variant exhibits at least 60%, 70%, 80%, 85%, 86%, 87%, 88%, 89%, 90%, 91%, 92%, 93%, 94%, 95%, 96%, 97%, 98%, or 99% sequence identity to the sequence of nucleotides set forth in any of SEQ ID NOS: 2, 4-9, 11, 13, 15-26 or 239, a degenerate thereof or a portion thereof that encodes a catalytically active santalene synthase.

For example, provided herein are codon-optimized variants of SEQ ID NO:2 that encode SaSSy set forth in SEQ ID NO:1. For example, the codon-optimized variant can contain one or more nucleotide changes to effect any one or more of the codon changes set forth in Table 7, so long as the resulting codon-optimized variant encodes a santalene synthase that catalyzes increased terpene production and/or an altered product profile. For example, the codon-optimized variant can contain at least or up to or 1, 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 110, 120, 130, 140, 150 or more nucleotide changes set forth in Table 7. For example, the codon-optimized variant contains all of the codon changes set forth in Table 7. Exemplary of such a codon-optimized variant is the sequence of nucleotides set forth in SEQ ID NO:3, or a portion thereof, that encodes an active santalene synthase and that catalyzes increased terpene production and/or an altered product profile.

Also, provided herein are codon-optimized variants of SEQ ID NO:11 that encode SspiSSy set forth in SEQ ID NO:10. For example, the codon-optimized variant can contain one or more nucleotide changes to effect any one or more of the codon changes set forth in Table 8, so long as the resulting codon-optimized variant encodes a santalene synthase that catalyzes increased terpene production and/or an altered product profile compared to the santalene synthase encoded by SEQ ID NO:10. For example, the codon-optimized variant can contain at least or up to or 1, 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 110, 120, 130, 140, 150 or more nucleotide changes set forth in Table 8. For example, the codon-optimized variant contains all of the codon changes set forth in Table 8. Exemplary of such a codon-optimized variant is the sequence of nucleotides set forth in SEQ ID NO:44, or a portion thereof that encodes an active santalene synthase that catalyzes increased terpene production and/or an altered product profile compared to the santalene synthase encoded by SEQ ID NO:10 or the corresponding active fragment thereof.

b. Amino Acid Replacements

Provided herein are modified santalene synthase polypeptides that contain an amino acid replacement (substitution) in a santalene synthase polypeptide. The amino acid replacements include those that increase total terpene production and/or effect an altered product profile compared to the total terpene production and/or terpene product profile of the unmodified sanatalene synthase not containing the amino acid replacements. Such amino acid replacements can be identified empirically or by rational design. For example, the amino acid replacements that confer such activities can be ascertained by methods utilizing random mutagenesis. In other cases, the amino acid replacements can be determined using rational strategies that include replacement of amino acids in a santalene synthase that correspond to amino acids in another terpene synthase with a different or desired activity. The different terpene synthase can be any terpene synthase, and generally is a sesquiterpene synthase. For example, the different terpene synthase can be a santalene species variant that differs from the santalene synthase that is being modified. In any of such examples, the resulting modified santalene synthase polypeptide can be tested for terpene production, and modified santalene synthase polypeptides that exhibit increased total terpene production and/or an altered product profile can be identified.

For example, in one strategy as exemplified herein, residues that differ between and among a santalene species (e.g. SspiSSy set forth in SEQ ID NO:10 versus SaSSy set forth in SEQ ID NO:1) can be incorporated into a reference santalene species (e.g., SaSSy set forth in SEQ ID NO:1) to generate modified santalene synthases, and changes in properties or activities assessed. In another example, amino acid replacements can be generated in a santalene synthase that are known or identified to be beneficial with respect to a desired property or activity in another terpene synthase. For example, as exemplified herein, amino acid replacements can be generated in a santalene synthase that are equivalent to, or correspond to, mutations in beta-farnesene synthase that improve enzymatic activity by alignment of the reference santalene synthase to be modified with the sequence of beta-farnesene synthase set forth in SEQ ID NO:305 (e.g., U.S. Pat. No. 8,236,512).

For example, provided herein are modified santalene synthase polypeptides that contain an amino acid replacement (substitution) in a santalene synthase polypeptide at an amino acid position corresponding to replacements that include, but are not limited to, T5S, M9T, M9V, D18N, T24I, T26N, A28G, A28S, N31A, I56K, I56R, L64E, L64Q, G70T, K73E, F74V, K85Q, F101L, F110L, I112N, I112Q, S117D, S117E, S117N, L140Y, N152S, G155D, C162V, V165I, S170A, Y176F, Y176H, N183E, N183K, N183D, T192A, C195Y, S198N, E205Q, K206G, K206Q, K206A, K206S, K206T, K213R, A240E, N255S, Q262R, L268W, A269P, F282W, I313L, G323A, G323E, S329F, S329H, S329L, I330M, L335H, S338Y, R342H, R342G, R342Q, R342S, R342T, C345L, C345P, C345T, V346A, K350L, K350R, N353D, N353P, F363Y, N364D, N367S, Y379I, S381G, S381P, F385L, S395A, F403Y, H404Y, G405S, T408A, V433I, A436C, H446R, L452I, I465M, A473E, A473L, A473P, A473V, S480A, C483R, E487A, E487S, V502I, S518E, Q521R, T548A, T548S, or conservative replacements thereof (see e.g., Table 2), with reference to SaSSy numbering of the santalene synthase set forth in SEQ ID NO:1.

It is understood that while the above amino acid replacements reference amino acid positions of a santalene synthase by SaSSy numbering set forth in SEQ ID NO:1, similar amino acid replacements can be made in other santalene synthases, and in particular in other *Santalum album* santalene synthases, by identification of corresponding amino acid residues and regions (see e.g., FIGS. 2 and 3). Thus, such modifications can be made in a santalene synthase, such as any set forth in SEQ ID NOS:1, 10, 12, 14, 27-43 or 258, active fragments thereof, or any variant thereof that has at least 60%, 70%, 80%, 85%, 86%, 87%, 88%, 89%, 90%, 91%, 92%, 93%, 94%, 95%, 96%, 97%, 98%, or 99% sequence identity to a santalene synthase polypeptide set forth in any of SEQ ID NOS:1, 10, 12, 14, 27-43 or 258 or a catalytically active fragment thereof. In particular, the amino acid replacements are made in the santalene synthase set forth in SEQ ID NO:1, or a catalytically active fragment thereof.

As described above, among the modified santalene synthase polypeptides provided herein are those that exhibit increased terpene production and/or an altered product profile compared to the santalene synthase that does not contain the modification(s) (i.e. unmodified santalene synthase). For example, modified santalene synthase polypeptides containing an amino acid replacement as described herein include those that catalyze the production of at least 105%, 106%, 107%, 108%, 109%, 110%, 115%, 120%, 125%, 130%, 135%, 140%, 145%, 150%, 160%, 170%, 180%, 200%, 250%, 300%, 350%, 400%, 500% or more of the amount of total terpene products (e.g., α-santalene, β-santalene, epi-beta-santalene and/or α-exo-bergamotene) produced from FPP compared to the santalene synthase polypeptide not containing modification(s) (i.e. the unmodified santalene synthase), such as the santalene synthase encoded by the sequence of nucleotides set forth in SEQ ID NO:2 or the codon-optimized variant thereof set forth in SEQ ID NO:3. Alternatively, or additionally, modified santalene synthase polypeptides containing an amino acid replacement as described herein include those that produce an altered product profile to result in production of at least one terpene product (e.g., α-santalene, β-santalene, epi-beta-santalene and/or α-exo-bergamotene) that is altered (increased or decreased) by at least 1%, 2%, 3%, 4%, 5%, 6%, 7%, 8%, 9%, 10%, 15%, 20%, 25%, 30%, 35%, 40%, 50%, 60%, 70%, 80%, 90% or more compared to same product produced in a host cell from FPP by the corresponding santalene synthase not containing modification(s) (i.e. the unmodified santalene synthase), such as the santalene synthase encoded by the sequence of nucleotides set forth in SEQ ID NO:2 or the codon-optimized variant thereof set forth in SEQ ID NO:3.

For example, modified santalene synthase polypeptides provided herein include an amino acid replacement or replacements that are associated with or confer increased total terpene production when expressed in host cells that produce FPP. As shown in the examples herein, non-limiting examples of amino acid replacements that increase terpene production include amino acid replacement corresponding to any one or more of A28G, N31A, I56K, L64E, L64Q, K73E, F110L, I112N, I112Q, S117E, S117D, S117N, S170A, N183E, N183K, N183D, K206G, K206Q, K206A, K206S, K206T, K213R, F282W, R342H, R342G, R342S, R342Q, C345L, C345P, C345T, V346A, F363Y, Y379I, S381P, F385L, G405S, T408A, A436C, L452I, S480A, E487S, S518E, T548A, T548S, or conservative replacements thereof, with reference to SaSSy numbering of the santalene synthase set forth in SEQ ID NO:1. In particular, non-limiting amino acid replacements include any one or more of I56K, L64E, L64Q, F110L, I112Q, S117E, S117D, S117N, S170A, N183E, N183K, N183D, K206G, K206Q, K206A, K206S, K206T, F282W, R342Q, C345L, C345P, C345T, F363Y, Y379I, G405S, T408A, L452I, E487S, S518E, T548A, T548S or conservative replacements thereof, with reference to SaSSy numbering of the santalene synthase set forth in SEQ ID NO:1. Modified santalene synthases containing the amino acid replacement corresponding to F282W alone or in combination with a mutation in the position corresponding to K206, such as K206G, K206S and K206A and/or the replacement corresponding to N183 exhibit increased terpene production and altered profile.

Modified santalene synthase polypeptides provided herein also include those that contain an amino acid replacement or replacements that are associated with or confer an altered product profile to result in production of at least one terpene product (e.g., α-santalene, β-santalene, epi-beta-santalene and/or α-exo-bergamotene) that is altered (increased or decreased) when the synthase is expressed in host cells that produce FPP. As shown in the examples herein, non-limiting examples of amino acid replacements that result in an altered product profile include amino acid replacement corresponding to any one or more of M9T, D18N, T24I, T26N, A28S, A28G, N183K, N183D, S198N, E205Q, K206A, F282W, I313L, S329F, L335H, S338Y, C345L, C345P, V346A, S381G, S381P, F385L, S395A, F403Y, H404Y, C483R, T548A, T548S or conservative replacements thereof, with reference to SaSSy numbering of the santalene synthase set forth in SEQ ID NO:1.

For example, as shown in the examples herein, amino acid replacements M9T, D18N, T24I, T26N, A28S, A28G, N183K, N183D, S198N, E205Q, K206A, F282W, I313L, S329F, L335H, S338Y, C345P, V346A, S381G, S381P, F385L, S395A, F403Y and H404Y are associated with a decreased production of α-exo-bergamotene, and a concomitant increase in the production of santalenes (α- and/or β-santalene). In particular, the amino acid replacement V346A confers an increased proportion of total santalenes, and in particular β-santalene, and a decreased proportion of bergamotene (e.g., compare SaSSy-1 to SaSSy-37). Amino acid replacement A28G results in a decreased proportion of bergamotene, and therefore an increased production of total santalenes, compared to a modified santalene synthase not containing the amino acid replacement (e.g., SaSSy-48 vs. SaSSy-6; and SaSSy-104). Also, amino acid replacement F282W confers a substantial reduction in the proportion of bergamotene, thus increasing the overall proportion of alpha- and beta-santalene within the profile. Amino acid replacement C345P confers a slightly increased proportion of alpha- and beta-santalene and decreased bergamotene, while amino acid replacement C345T did not result in an altered product profile.

As demonstrated herein, modified santalene synthases containing the amino acid replacement corresponding to F282W exhibit altered product profile, particularly increased production of the santalenes. While the K206T alone is neutral with respect to production and product profile, the combination of K206T with F282W produces a synthase that exhibits an increased total production compared to a santalene synthase containing F282W, alone, and retain the altered product profile of F282W (e.g., compare SaSSy-101 and SaSSy-102). Due to the changes in the product profile catalyzed by a modified santalene synthase containing K206T/F282W amino acid replacements, and the concomitant increase in terpene production due to the presence of the K206T amino acid replacement, such a modified santalene synthase catalyzes increased production of total santalene products (α- and/or β-santalene). Modified synthases that include the mutations K206G/F282W, such as SaSSy-135, catalyze increased production of terpenes and altered product profile. The combination of mutations at a position corresponding to K206, such as K206A, K206G, K206S, or K206T, with F282W and N183K catalyze increased production of terpenes, and alter the product profile to produce more α- and/or β-santalenes.

In other examples, as shown in the examples herein, amino acid replacements C483R, T548A and T548S are associated with a decreased production of total santalenes (e.g., α- and/or β-santalene), and a concomitant increase in the total production of α-exo-bergamotene. For example, SaSSy-43, which contains the amino acid replacement C483R, produced only 8.53% and 5.37% α- and β-santalene, respectively, as compared to codon-optimized SaSSy. Also, variants SaSSy-123 and SaSSy-124, which both contain a replacement at position 548 (T548A and T548S, respectively), also show predominant production of alpha-exo-bergamotene compared to the other products. In particular, due to the increase in total terpene production also conferred by the amino acid replacements T548A and T548S, a modified santalene synthase containing these amino acid replacements is able to produce a substantially increased amount of alpha-exo-bergamotene. Also as shown in variants herein, other amino acid replacements that also are associated with an increased production of α-exo-bergamotene and a slight decrease or no significant change in one or both of α- or β-santalene include C345L.

Such modified santalene synthase polypeptides provided herein that catalyze increased production of total terpene products can contain one or more further amino acid replacements, such as any others described herein and in other sections. Such replacements can include amino acid replacements that alone are neutral or decrease total terpene production, so long as the resulting modified santalene synthase polypeptide catalyzes increased production of terpene products from FPP (e.g., in a host cell). For example, it is found herein that replacement of residues in a SaSSy santalene synthase to corresponding residues in SspiSSy, i.e. M9T, T24I, T26N, A28S, N152S, G155D, V165I, Y176F, T192A, C195Y, S198N, E205Q, A240E, G323A, I330M, L335H, S338Y, S381G, S395A, F403Y, V433I, I465M and V502I with reference to SaSSy numbering of the santalene synthase set forth in SEQ ID NO:1, are neutral with respect to total terpene production. Nevertheless, it is also found herein that a modified SaSSy/SspiSSy hybrid exhibits a slightly different product profile compared to a modified santalene synthase that does not include these SspiSSy hybrid variants, due to a decrease in production of beta-santalene, and a slight increase in production of alpha-santalene and bergamotene (see e.g., SaSSy-2). Also, the SaSSy-2 19 amino acid hybrid also produces a profile with approximately 2% lower proportion of alpha- plus beta-santalene compared to the modified santalene synthase not containing the amino acid replacements.

c. N-terminal or C-terminal Deletions

Provided herein are modified santalene synthase polypeptides that are N- or C-terminal truncated variants and contain a deletion of one or more contiguous amino acids at the N- or C-terminus, so long as the resulting modified santalene synthase polypeptide exhibits or retains catalytic activity (i.e. the ability to catalyze the formation of α-santalene, β-santalene and/or α-exo-bergamotene from an acyclic pyrophosphate terpene precursor, typically FPP). For example, the modified santalene synthase can contain deletion of 1 to 100 contiguous amino acids at the N-terminus or C-terminus, for example deletion of or up to 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 78, 79, 80, 81, 82, 83, 84, 85, 86, 87, 88, 89, 90, 91, 92, 93, 94, 95, 96, 97, 98, 99 or 100 contiguous amino acids at the N- or C-terminus.

Among the modified santalene synthase polypeptides provided herein that contain a deletion of one or more contiguous amino acid residues at the N- or C-terminus are those that exhibit increased terpene production and/or altered product profile compared to the santalene synthase that does not contain the modification(s) (i.e. unmodified santalene synthase). For example, modified santalene synthase polypeptides containing a deletion of one or more contiguous amino acid residues as described herein include those that catalyze the production of at least 105%, 106%, 107%, 108%, 109%, 110%, 115%, 120%, 125%, 130%, 135%, 140%, 145%, 150%, 160%, 170%, 180%, 200%, 250%, 300%, 350%, 400%, 500% or more of the amount of total terpene products (e.g., α-santalene, β-santalene, α-exo-bergamotene) produced from FPP compared to the santalene synthase polypeptide not containing the modification(s) (i.e. the unmodified santalene synthase), such as the santalene synthase encoded by the sequence of nucleotides set forth in SEQ ID NO:2 or the codon-optimized variant thereof set forth in SEQ ID NO:3. Alternatively, or additionally, modified santalene synthase polypeptides that contain a deletion of one or more contiguous amino acid residues at the N- or C-terminus, as described herein, include those that produce an altered product profile to result in production of at least one terpene product (e.g., α-santalene, β-santalene and/or α-exo-bergamotene) that is altered (increased or decreased) by at least 1%, 2%, 3%, 4%, 5%, 6%, 7%, 8%, 9%, 10%, 15%, 20%, 25%, 30%, 35%, 40%, 50%, 60%, 70%, 80%, 90% or more compared to same product produced in a host cell from FPP by the corresponding santalene synthase not containing modification(s) (i.e. the unmodified santalene synthase), such as the santalene synthase encoded by the sequence of nucleotides set forth in SEQ ID NO:2 or the codon-optimized variant thereof set forth in SEQ ID NO:3.

For example, modified santalene synthase polypeptides provided herein include N-terminal truncation mutants that contain deletion of contiguous amino acid residues at the N-terminus so that the polypeptide lacks all or a portion of the RR motif. For example, the polypeptide lacks the first contiguous 33, 34, 35, 36, 37, 38, 39, 40, 41, 42, 43, 44, 45, 46, 47, 48, 49 or 50 amino acids at the N-terminus compared to the corresponding unmodified santalene synthase, such as the santalene synthase set forth in SEQ ID NO:1. As shown in the examples herein, such polypeptides are associated with or confer an altered product profile to result in production of at least one terpene product (e.g., α-santalene, β-santalene and/or α-exo-bergamotene) that is altered (increased or decreased) when the synthase is expressed in host cells that produce FPP. It is understood that while reference to deletion of residues up to and including the RR motif are with reference to a santalene synthase set forth in SEQ ID NO:1, similar deletions can be made in other santalene synthases, and in particular in other *Santalum album* santalene synthases, by identification of corresponding amino acid residues and regions (see e.g., FIGS. 2 and 3). Thus, such modifications can be made in a santalene synthase, such as any set forth in SEQ ID NOS:1, 10, 12, 14, 27-43 or 258, a catalytically active fragment thereof, or any variant thereof that has at least 60%, 70%, 80%, 85%, 86%, 87%, 88%, 89%, 90%, 91%, 92%, 93%, 94%, 95%, 96%, 97%, 98%, or 99% sequence identity to a santalene synthase polypeptide set forth in any of SEQ ID NOS:1, 10, 12, 14, 27-43 or 258 or a catalytically active fragment thereof.

For example, provided herein are N-terminal deletion or truncation mutants that lack N-terminal residues up to and including the RR residues of the RR motif (R(R/P)X$_8$ W). Exemplary of such a truncation mutant is a modified santalene synthase that includes deletion of amino acid residues 1-33 with reference to the unmodified santalene synthase, such as the santalene synthase set forth in SEQ ID NO:1. As shown in the Examples herein, such an N-terminal truncation mutant results in an altered product profile with alpha-exo-bergamotene as the major product, i.e. gives 85% alpha-exo-bergamotene as the product compared to synthases that are not deleted in the N-terminus, such as the santalene synthase encoded by the sequence of nucleotides set forth in SEQ ID NO:2 or the codon-optimized variant thereof set forth in SEQ ID NO:3 (e.g., SaSSy-112).

Any of the N-terminal or C-terminal mutants provided herein also include those that are active fragments of a modified santalene synthase polypeptide provided herein, such that the active fragment contains any one or more of the modifications of a modified santalene synthase as described herein. Such fragments retain one or more properties of the full-length modified santalene synthase or the corresponding unmodified santalene synthase. The modified active fragments exhibit santalene synthase activity (i.e. catalyze the formation of α-santalene, β-santalene and/or α-exo-bergamotene from an acyclic pyrophosphate terpene precursor, typically FPP). Typically, as described above, the modified active fragments exhibit increased terpene production and/or altered product profile compared to the santalene synthase that does not contain the modification(s) (i.e. unmodified santalene synthase).

d. Domain Swaps

Provided herein are modified santalene synthase polypeptides that are swap mutants, whereby all or a portion of one or more structural domains is replaced with a corresponding structural domain of another terpene polypeptide. Table 3 below identifies structural domains within santalene synthase as determined by structure-based alignment modeling of corresponding domains to bornyl diphosphate synthase (BDS) (PDB entry 1n24; Whittington et al. (2002) *Proc. Natl. Acad. Sci.*, 99:15375-15380). The amino acid residues corresponding to structural domains in santalene synthase are set forth in Table 3 with numbering based on the corresponding BDS residues (BDS numbering) or with numbering based on the SaSSy santalene synthase polypeptide set forth in SEQ ID NO:1.

TABLE 3

Structural Domains

| Structural Domain | SaSSy numbering | BDS numbering |
|---|---|---|
| unstructured loop 1 (N-terminus) | 1-42 | 1-65 |
| RR motif (RRX$_8$W) | 32-42 | 55-65 |
| alpha helix 1 | 43-50 | 66-73 |
| unstructured loop 2 | 51-72 | 74-93 |
| alpha helix 2 | 73-77 | 94-98 |
| unstructured loop 3 | 78-81 | 99-102 |
| alpha helix 3 | 82-92 | 103-113 |
| unstructured loop 4 | 93-101 | 114-122 |
| alpha helix 4 | 102-115 | 123-136 |
| unstructured loop 5 | 116-125 | 137-150 |
| alpha helix 5 | 126-137 | 151-162 |
| unstructured loop 6 | 138-149 | 163-174 |
| beta strand 1 | 150-152 | 175-177 |
| unstructured loop 7 | 153-155 | 178-181 |
| beta strand 2 | 156-158 | 182-184 |
| unstructured loop 8 | 159 | 185 |
| alpha helix 6 | 160-162 | 186-188 |
| unstructured loop 9 | 163-165 | 189-191 |
| alpha helix 7 | 166-175 | 192-201 |
| unstructured loop 10 | 176-183 | 202-209 |
| alpha helix 8 | 184-198 | 210-224 |
| unstructured loop 11 | 199-204 | 225-233 |
| alpha helix 9 | 205-217 | 234-246 |
| unstructured loop 12 | 218-228 | 247-257 |
| alpha helix 10 | 229-237 | 258-266 |
| unstructured loop 13 | 238-243 | 267-272 |
| alpha helix A | 244-275 | 273-304 |
| A-C loop | 276-285 | 305-315 |
| alpha helix C | 286-298 | 316-328 |
| unstructured loop 15 | 299-302 | 329-332 |
| alpha helix D | 303-325 | 333-355 |
| unstructured loop 16 | 326-328 | 356-358 |
| alpha helix D1 | 329-343 | 359-373 |
| unstructured loop 17 | 344-345 | 374-375 |
| alpha helix D2 | 346-351 | 376-381 |
| alpha helix E | 352-378 | 382-408 |
| unstructured loop 18 | 379-380 | 409-410 |
| alpha helix F | 381-406 | 411-436 |
| unstructured loop 19 | 407-409 | 437-439 |
| alpha helix G1 | 410-422 | 440-452 |
| alpha helix G2 | 423-433 | 453-463 |
| unstructured loop 20 | 434-437 | 464-470 |
| alpha helix H1 | 438-448 | 471-481 |
| alpha helix H2 | 449-475 | 482-508 |
| unstructured loop 21 | 476-478 | 509-511 |
| alpha helix α1 | 479-489 | 512-522 |
| unstructured loop 22 | 490 | 523 |
| alpha helix I | 491-516 | 524-549 |
| unstructured loop 23 | 517-520 | 550-553 |
| alpha helix J | 521-539 | 554-572 |
| unstructured loop 24 | 540-551 | 573-584 |
| alpha helix K | 552-561 | 585-594 |
| unstructured loop 25 | 562-569 | 595-598 |

Any one or more of the above endogenous structural domains, or a contiguous portion of any one or more of the above structural domains, in a santalene synthase polypeptide (i.e. unmodified santalene synthase, e.g., any of SEQ ID NOS: 1, 10, 12, 14, 27-43 or 258), can be substituted replaced with the corresponding heterologous structural domain(s), or a contiguous portion thereof, of another terpene synthase or synthase. For example, 3, 4, 5, 6, 7, 8, 9, 10 or more contiguous amino acids from a domain or region in a santalene synthase can be substituted or replaced with 3, 4, 5, 6, 7, 8, 9, 10 or more contiguous amino acids from the corresponding region from a second terpene synthase. In some examples, one or more amino acid residues adjacent to the endogenous domain of the santalene synthase also are replaced, and/or one or more amino acid residues adjacent to the heterologous domain also are used in the replacement.

The modified santalene synthase polypeptides provided herein can contain replacement or substitution of 1, 2, 3, 4, 5, 6, 7, 8, 9 or 10 of the above structural domains, or a contiguous portion of any 1, 2, 3, 4, 5, 6, 7, 8, 9 or 10 of the above structural domains, with the corresponding heterologous domains or contiguous portions thereof from another terpene synthase or synthase. For example, the modified santalene synthase contains substitution or replacement of at least 2 endogenous domains or contiguous portions thereof. The substituted or replaced domains or regions can include those that are adjacent in sequence or that are separated in sequence from each other. For example, modified santalene synthases provided herein include those containing modifications in which all or a part of a contiguous portion of a first domain and all or a part of a contiguous portion of a second adjacent domain are replaced with the corresponding domains (or portions thereof) from another terpene synthase. In some cases, the modified santalene synthase contains more than one heterologous domain or contiguous portion thereof from at least two different terpene synthases, such as at least 3, 4, 5, 6, 7, 8, 9 or 10 different terpene synthases.

The other terpene synthase can be any synthase that is known to a skilled artisan, including any monoterpene, diterpene or sesquiterpene synthase (see e.g., Degenhardt et al. (2009) *Phytochemistry*, 70:1621-1637; U.S. Patent Publication No. US20120246767). Examples of the other terpene synthases, include, but are not limited to, *Hyoscyamus muticus* Vestipiradiene synthase (HVS; set forth in SEQ ID NO:276, and encoded by a sequence of nucleotides set forth in SEQ ID NO:197), (+)-Bornyl diphosphate synthase (BDS; set forth in SEQ ID NO:268, and encoded by a sequence of nucleotides set forth in SEQ ID NO:198), citrus valencene synthase (CVS; set forth in SEQ ID NO:293, and encoded by a sequence of nucleotides set forth in SEQ ID NO:292), a modified citrus valencene synthase (modified CVS; see e.g., any described in U.S. Patent Publication No. US20120246767; for example, CVS V19 set forth in SEQ ID NO: 269, and encoded by a sequence of nucleotides set forth in SEQ ID NO:199), *Vitis vinifera* valencene synthase (Vv CVS; set forth in SEQ ID NOS:270, and encoded by a sequence of nucleotides set forth in SEQ ID NO:200), bergamotene synthase (BS; set forth in SEQ ID NO:271, and encoded by a sequence of nucleotides set forth in SEQ ID NO:201), *Nicotiana tabacum* 5-epi-aristolochene synthase (TEAS; set forth in SEQ ID NO:273, and encoded by a sequence of nucleotides set forth in SEQ ID NO:216), germacrene A (set forth in SEQ ID NO:274, and encoded by a sequence of nucleotides set forth in SEQ ID NO:217), amorpha-4,11-diene synthase (ADS; set forth in SEQ ID NO:275, and encoded by a sequence of nucleotides set forth in SEQ ID NO:218) or *Hyoscyamus muticus* premnaspirodiene synthase (HPS; set forth in SEQ ID NO:272, and encoded by a sequence of nucleotides set forth in SEQ ID NO:221).

Table 4 sets forth an exemplary structural domain or domains or portions thereof that are replaced in a modified santalene synthase polypeptide provided herein. The Table identifies exemplary corresponding replacing amino acid residues for exemplified domain regions from other terpene synthases. Any of the below domains or regions or portions thereof in a santalene synthase can be replaced with the corresponding region from another terpene synthase or synthases. Based on the exemplification in the Table and the knowledge of a skilled artisan, it is within the level of a skilled artisan to identify the corresponding residues in another terpene synthase.

TABLE 4

Exemplary Domain(s) or portions

| Replaced Amino Acids in Santalene Synthase | Corresponding Region From Another Terpene Synthase, i.e. Replacing Amino Acids | | | | | |
|---|---|---|---|---|---|---|
| (SaSSy numbering) | HVS | BDS | CVS | CVS Vv19 | Vv CVS | BS |
| 1-31 | 1-16 | 21-54 | 1-7 | 1-7 | 1-18 | 1-4 |
| 73-79 | 56-62 | 94-100 | 49-55 | 49-55 | 59-65 | 44-50 |
| 78-81 | 61-64 | 99-102 | 54-57 | 54-57 | 64-67 | 49-52 |
| 97-100 | 82-85 | 118-121 | 74-77 | 74-77 | 85-88 | 68-71 |
| 103-115 | 88-100 | 124-136 | 80-92 | 80-92 | 91-103 | 74-86 |
| 116-124 | 101-111 | 137-149 | 93-100 | 93-100 | 104-113 | 87-95 |
| 138-166 | 125-153 | 163-192 | 114-142 | 114-142 | 127-155 | 109-137 |
| 138-168 | 125-155 | 163-194 | 114-144 | 114-144 | 127-157 | 109-139 |
| 198-207 | 185-193 | 224-236 | 174-184 | 174-184 | 187-195 | 169-178 |
| 330-345 | 317-332 | 360-375 | 310-325 | 310-325 | 319-334 | 302-320 |

Any methods known in the art for generating chimeric polypeptides can be used to replace all or a contiguous portion of a domain or a santalene synthase with all or a contiguous portion of the corresponding domain of another terpene synthase. For example, corresponding domains or regions can be exchanged using any suitable recombinant method known in the art, or by in vitro synthesis. It is understood that primer-errors, PCR errors and/or other errors in the cloning or recombinant methods can result in errors such that the resulting swapped or replaced region or domain does not exhibit an amino acid sequence that is identical to the corresponding region from the second terpene synthase.

For example, a two stage overlapping PCR method can be employed. In such methods, primers that introduce mutations at a plurality of codon positions in the nucleic acids encoding the targeted domain or portion thereof to be modified in the santalene synthase can be employed, wherein the mutations together form the heterologous region (i.e. the corresponding region from the another terpene synthase). In an exemplary PCR-based method, the first stage PCR uses (i) a downstream primer that anneals downstream of the region that is being replaced with a mutagenic primer that includes approximately fifteen nucleotides (or an effective number to effect annealing, such as 5, 6, 7, 8, 9, 10, 11, 12, 13, 14, 15, 16, 17, 20, or 25 nucleotides or more) of homologous sequence on each side of the domain or region to be exchanged or randomized, flanking the region to be imported into the target gene, and (ii) an upstream primer that anneals upstream of the region that is being replaced together with an opposite strand mutagenic primer that also includes approximately fifteen nucleotides (or an effective number to effect annealing, such as 5, 6, 7, 8, 9, 10, 11, 12, 13, 14, 15, 16, 17, 20, or 25 nucleotides or more) of homologous sequence on each side of the domain or region to be exchanged or randomized, flanking the region to be imported into the target gene. The nucleotides in the mutagenic primers between the flanking regions from the santalene synthase can contain codons for the corresponding region of the second terpene synthase. Alternatively, for example, randomized amino acids can be used to replace specific domains or regions. In such instances where the amino acids in a domain or region are to be randomized, nucleotides of the mutagenic primers between the flanking regions from the santalene synthase can contain random nucleotides. An overlapping PCR is then performed to join the two fragments, using the upstream and downstream oligo. The resulting PCR product can then be cloned into any suitable vector for expression of the modified terpene synthase.

Exemplary domain swap modifications, i.e. replacement of a domain or region in a santalene synthase with heterologous amino acids of the corresponding domain or region from another terpene synthase, are set forth in Table 5. The replaced (deleted) amino acids corresponding to residues in SaSSy set forth in SEQ ID NO:1 are indicated, as well as the inserted amino acids from the corresponding domain or region of the other terpene synthase. Likewise, the effective amino acid modifications (i.e. deletion, insertion or replacement) that result from the swap also are indicated. The modified santalene synthase can contain any one or more of the domain swap modifications set forth in Table 5, such as at least 2, 3, 4, 5, 6, 7, 8, 9 or 10 of the domain swap modifications. Hence, by virtue of domain swap modifications, the number of effective amino acid modifications in a modified santalene synthase polypeptide can be 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more.

It is understood that while Table 5 references amino acid positions of a santalene synthase by SaSSy numbering set forth in SEQ ID NO:1, similar swaps can be made in other santalene synthases, and in particular in other *Santalum album* santalene synthases, by identification of corresponding amino acid residues and regions (see e.g., FIGS. 2 and 3). Thus, such modifications can be made in a santalene synthase, such as any set forth in SEQ ID NOS:1, 10, 12, 14, 27-43 or 258, a catalytically active fragment thereof, or any variant thereof that has at least 60%, 70%, 80%, 85%, 86%, 87%, 88%, 89%, 90%, 91%, 92%, 93%, 94%, 95%, 96%, 97%, 98%, or 99% sequence identity to a santalene synthase polypeptide set forth in any of SEQ ID NOS:1, 10, 12, 14, 27-43 or 258 or a catalytically active fragment thereof

TABLE 5

| Exemplary Swap Modifications | | | |
|---|---|---|---|
| Domain Swap Modification | Replaced (deleted) Amino Acids (SEQ ID NO) | Replacing (Inserted) Amino Acids (SEQ ID NO) | Effective Amino Acid Modifications |
| SaSSy1-31swap HVS1-16 | MDSSTATAMTAPFI DPTDHVNLKTDTD | MAPAIVMSNYEEE EIV | M1→--/D2→--/S3→--/S4→--/ T5→--/A6→--/T7→--/ |

TABLE 5-continued Exemplary Swap Modifications

| Domain Swap Modification | Replaced (deleted) Amino Acids (SEQ ID NO) | Replacing (Inserted) Amino Acids (SEQ ID NO) | Effective Amino Acid Modifications |
|---|---|---|---|
| | ASEN (SEQ ID NO: 294) | (SEQ ID NO: 202) | A8→--/M9→--/T10→--/ A11→--/P12→--/F13→--/ I14→M1/D15→A2/P16→--/ T17→--/D18→P3/H19→A4/ V20→15/N21→V6/L22→M7/ K23→S8/T24→N9/D25→Y10/ T26→E11/D27→E12/ A28→E13/S29→E14/E30→I15/ N31→V16 |
| SaSSy73-79swap BDS94-100 | KFMFGAP (SEQ ID NO: 295) | RILLKEK (SEQ ID NO: 203) | K73R/F74I/M75L/F76L/ G77K/A78E/P79K |
| SaSSy78-81swap BDS99-102 | APME (SEQ ID NO: 296) | EKME (SEQ ID NO: 204) | A78E/P79K |
| SaSSy97-100swap CVS(V19)74-77 | LNHL (SEQ ID NO: 297) | VAYH (SEQ ID NO: 205) | L97V/N98A/H99Y/L100H |
| SaSSy103-115swap CVS(V19)80-92 | TEIKEALFSIYKD (SEQ ID NO: 298) | KEIEDAIQQLCPI (SEQ ID NO: 206) | T103K/K106E/E107D/L109I/ F110Q/S111Q/I112L/Y113C/ K114P/D115I |
| SaSSy116-124swap CVS(V19)93-100 | GSNGWWFGH (SEQ ID NO: 299) | HIDSDKAD (SEQ ID NO: 207) | G116H/S117I/N118D/G119S/ W120D/W121--/F122→K121/ G123→A122/H124→D123 |
| SaSSy116-124swap vVCVS104-113 | GSNGWWFGH (SEQ ID NO: 299) | FHDCNDMDGD (SEQ ID NO: 208) | G116F/S117H/N118D/ ---→C119/G119→N120/ W120→D121/W121→M122/ F122→D123/H124→D125 |
| SaSSy116-124swap BDS137-149 | GSNGWWFGH (SEQ ID NO: 299) | HKCFHNNEVEKMD (SEQ ID NO: 209) | G116H/S117K/---→C118/ ---→F119/---→H120/---→N121/ G119→E123/W120→V124/ W121→E125/F122→K126/ G123→M127/H124→D128 |
| SaSSy138-166swap BS109-136 | CGLFIPQDVFKTFQNKTGEFDMKLCDNVK (SEQ ID NO: 300) | HGHHVPQEAFCSFMDDVRNFRAWLCEDVR (SEQ ID NO: 210) | C138H/L140H/F141H/I142V/ D145E/V146A/K148C/T149S/ Q151M/N152D/K153D/T154V/ G155R/E156N/D158R/M159A/ K160W/D163E/N164D/K166R |
| SaSSy138-166swap BS109-136** | CGLFIPQDVFKTFQNKTGEFDMKLCDNVK (SEQ ID NO: 300) | HGHHVPQE<u>V</u>FCSFMDD<u>V</u>GNFRAWLCEDVR (SEQ ID NO: 215) | C138H/L140H/F141H/I142V/ D145E/K148C/T149S/Q151M/ N152D/K153D/T154V/E156N/ D158R/M159A/K160W/D163E/ N164D/K166R |
| SaSSy138-168swap CVS(V19)114-144 | CGLFIPQDVFKTFQNKTGEFDMKLCDNVKGL (SEQ ID NO: 301) | QGIKISCDVFEQFKDDEGRFKSSLINDVQGM (SEQ ID NO: 211) | C138Q/L140I/F141I/P143S/ Q144C/K148E/T149Q/Q151K/ N152D/K153D/T154E/E156R/ D158K/M1595/K1605/C162I/ D163N/N164D/K166Q/L168M |
| SaSSy138-168swap CVS(V19)114-144** | CGLFIPQDVFKTFQNKTGEFDMKLCDNVKGL (SEQ ID NO: 301) | QGIKISCDVFEQFKDDE<u>D</u>RFKSSLIND<u>I</u>QGM (SEQ ID NO: 212) | C138Q/L140I/F141I/P143S/ Q144C/K148E/T149Q/Q151K/ N152D/K153D/T154E/G155D/ E156R/D158K/M1595/K1605/ C162I/D163N/N164D/V165I/ K166Q/L168M |
| SaSSy198-207swap VvCVS187-195 | SAWENISEKW (SEQ ID NO: 302) | AMVESLGYH (SEQ ID NO: 213) | S198A/A199M/W200V/N202S/ I203L/S204G/E205Y/K206→--/ W207→H206 |
| SaSSy330-348swap B5302-320 | IDELDLYTSSVERWSCVEI (SEQ ID NO: 303) | LEELQLFTQTIERWDINSL (SEQ ID NO: 214) | I330L/D331E/D334Q/Y336F/ S338Q/5339T/V3401/S344D/ C345I/V346N/E3475/1348L |

**modified in 2 residues in the swap region compared to the corresponding synthase residues. Modified residues underlined.

As described above, among the modified santalene synthase polypeptides provided herein are those that exhibit increased terpene production and/or altered product profile compared to the santalene synthase that does not contain the modification(s) (i.e. unmodified santalene synthase). For example, modified santalene synthase polypeptides that are swap mutants, as described herein, include those that catalyze the production of at least 105%, 106%, 107%, 108%, 109%, 110%, 115%, 120%, 125%, 130%, 135%, 140%, 145%, 150%, 160%, 170%, 180%, 200%, 250%, 300%, 350%, 400%, 500% or more of the amount of total terpene products (e.g., α-santalene, β-santalene, α-exo-bergamotene) produced from FPP compared to the santalene synthase polypeptide not containing modification(s) (i.e. the unmodified santalene synthase), such as the santalene synthase encoded by the sequence of nucleotides set forth in SEQ ID NO:2 or the codon-optimized variant thereof set forth in SEQ ID NO:3. Alternatively or additionally, modified santalene synthase polypeptides that are swap mutants as described herein include those that produce an altered product profile to result in production of at least one terpene product (e.g., α-santalene, β-santalene and/or α-exo-bergamotene) that is altered (increased or decreased) by at least 1%, 2%, 3%, 4%, 5%, 6%, 7%, 8%, 9%, 10%, 15%, 20%, 25%, 30%, 35%, 40%, 50%, 60%, 70%, 80%, 90% or more compared to same product produced in a host cell from FPP by the corresponding santalene synthase not containing modification(s) (i.e. the unmodified santalene synthase), such as the santalene synthase encoded by the sequence of nucleotides set forth in SEQ ID NO:2 or the codon-optimized variant thereof set forth in SEQ ID NO:3.

For example, modified santalene synthase polypeptides provided herein are swap mutants that contain all or a portion of a corresponding heterologous structural domain from another terpene polypeptide that results in or is associated with increased total terpene production by the modified santalene synthase when it is expressed in host cells that produce FPP. For example, as shown in the examples herein, non-limiting examples of domain swaps that increase terpene production include, but are not limited to, swaps that correspond to SaSSy73-79swapBDS94-100; SaSSy97-100swapCVS(V19)74-77; SaSSy103-115swapCVS(V19)80-92; SaSSy138-168swapCVS(V19)114-144; SaSSy138-168swapCVS(V19)114-144**; SaSSy116-124swapCVS(V19)93-100; or SaSSy198-207swapCVS(Vv)187-195, with reference to SaSSy numbering set forth in SEQ ID NO:1. For example, provided herein are modified santalene synthase polypeptides that contain a heterologous domain from (+)-Bornyl diphosphate synthase (BDS) corresponding to the swap SaSSy73-79swapBDS94-100, with reference to SaSSy numbering set forth in SEQ ID NO:1.

Modified santalene synthase polypeptides provided herein also include swap mutants that contain all or a portion of a corresponding heterologous structural domain from another terpene polypeptide that results in or is associated with an altered product profile to result in production of at least one terpene product (e.g., α-santalene, β-santalene and/or α-exo-bergamotene) that is altered (increased or decreased) when the modified synthase is expressed in host cells that produce FPP. As shown in the examples herein, non-limiting examples of domain swaps that result in an altered product profile include, but are not limited to, swaps that correspond to SaSSy1-31swapHVS1-16; SaSSy97-100swapCVS(V19)74-77; SaSSy103-115swapCVS(V19)80-92; SaSSy138-166swapBS109-136**; or SaSSy116-124swapCVS(V19)93-100, with reference to SaSSy numbering set forth in SEQ ID NO:1. For example, a modified santalene synthase provided herein that exhibits an altered product profile can contain a domain swap of the N-terminus corresponding to up to, but not including, the RR motif (e.g., residues 1-31 of santalene synthase set forth in SEQ ID NO:1) with a corresponding heterologous domain or region from another synthase, such as any set forth in Table 4. For example, a domain swap of amino acid residues 1-31 of santalene synthase with corresponding heterologous residues 1-16 of HVS, results in a modified santalene synthase that produces an increased proportion of alpha- and beta-santalene, and decreased bergamotene, compared to a santalene synthase that does not include the domain swap (see e.g., SaSSy-10).

2. Exemplary Modified Polypeptides and Encoding Nucleic Acid Molecules

Provided herein are modified santalene synthase polypeptides, and encoding nucleic acid molecules, that contain one or more modifications compared to an unmodified santalene synthase and exhibit activity to catalyze the formation of terpene products (e.g., α-santalene, β-santalene, α-exo-bergamotene and/or other terpenes) from any suitable acyclic pyrophosphate terpene precursor, such as FPP. In particular, the modified santalene synthase polypeptides provided herein exhibit activity to catalyze increased total terpene production and/or an altered product profile compared to the unmodified santalene synthase not containing the modifications. The modified santalene synthase, or encoding nucleic acid molecule, provided herein, can contain any one or more of the modifications described in subsections C.a-d above, such as modification by codon-optimization, amino acid replacement, amino acid deletion (e.g., N-terminal or C-terminal deletion) and/or domain swaps.

Table 6 provides non-limiting examples of exemplary modified santalene synthase polypeptides, and encoding nucleic acid molecules. In Table 6, the modifications are identified with reference to the santalene synthase set forth in SEQ ID NO:1. The corresponding modifications can be incorporated into any santalene synthase polypeptide, such as a santalene synthase set forth in any of SEQ ID NOS:1, 10, 12, 14, 27-43 or 258, an active fragment thereof, or any variant thereof that has at least 60%, 70%, 80%, 85%, 86%, 87%, 88%, 89%, 90%, 91%, 92%, 93%, 94%, 95%, 96%, 97%, 98%, or 99% sequence identity to a santalene synthase polypeptide set forth in any of SEQ ID NOS:1, 10, 12, 14, 27-43 or 258 or an active fragment thereof. In particular examples, the modifications are incorporated into the santalene synthase set forth in SEQ ID NO:1, and encoded by the sequence of nucleotides set forth in SEQ ID NO:2. Table 6 provides exemplary sequence identifiers (SEQ ID NO) for the amino acid (aa) and nucleotide (na) sequence of the exemplary variants represented in the Table.

TABLE 6

Exemplary Modified Santalene Synthases

| Variant Name | Mutation(s) Amino Acid Replacement(s) or Deletions | Domain Swap(s) | SEQ ID NO aa | SEQ ID NO na |
|---|---|---|---|---|
| codon-optimized SaSSy | — | — | 1 | 3 |
| codon-optimized SspiSSy | — | — | 44 | 10 |
| SaSSy-1 | V356A/F385L | SaSSy116-124swapCVS(V19)93-100 | 131 | 45 |
| SaSSy-2 | N152S/G155D/V165I/Y176F/T192A/C195Y/S198N/E205Q/A240E/G323A/I330M/L335H/S338Y/S381G/S395A/F403Y/V433I/I465M/V502I | — | 132 | 46 |
| SaSSy-3 | K85Q/F101L/Y176F/T192A/C195Y/A240E/G323A/S329H/I330M/V433I/H446R/I465M/V502I | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 133 | 47 |
| SaSSy-39 | | | 133 | 83 |
| SaSSy-40 | | | 133 | 84 |
| SaSSy-62 | | | 133 | 106 |
| SaSSy-4 | K85Q/F101L/Y176F/T192A/C195Y/A240E/G323A/S329T/I330M/L335H/S338Y/N367S/S381G/F385L/S395A/V433I/F403Y/H446R/I465M/V502I | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 134 | 48 |
| SaSSy-5 | M9T/D18N/T24I/T26N/A28S/K85Q/F101L/Y176F/T192A/C195Y/A240E/G323A/I330M/S381G/F385L/S395A/F403Y/V433I/H446R/I465M/V502I | SaSSy73-79swapBDS94-100/ SaSSy116-124swapCVS(V19)93-100/ SaSSy138-168swapCVS(V19)114-144**/ SaSSy198-207swapCVS(Vv)187-195 | 135 | 49 |
| SaSSy-6 | K85Q/F101L/Y176F/T192A/C195Y/A240E/G323A/S329H/I330M/V346A/K350R/N353D/V433I/H446R/I465M/V502I | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 136 | 50 |
| SaSSy-41 | | | 136 | 85 |
| SaSSy-52 | | | 136 | 96 |
| SaSSy-56 | | | 136 | 100 |
| SaSSy-61 | | | 136 | 105 |
| SaSSy-68 | | | 136 | 112 |
| SaSSy-69 | | | 136 | 113 |
| SaSSy-70 | | | 136 | 114 |
| SaSSy-71 | | | 136 | 115 |
| SaSSy-73 | | | 136 | 117 |
| SaSSy-75 | | | 136 | 119 |
| SaSSy-79 | | | 136 | 123 |
| SaSSy-87 | | | 136 | 219 |
| SaSSy-88 | | | 136 | 220 |
| SaSSy-114 | | | 136 | 265 |
| SaSSy-115 | | | 136 | 81 |
| SaSSy-7 | K85Q | SaSSy78-81swapBDS99-102 | 137 | 51 |
| SaSSy-8 | — | SaSSy73-79swapBDS94-100 | 138 | 52 |
| SaSSy-9 | | | 138 | 53 |
| SaSSy-10 | S329F | SaSSy1-31swapHVS1-16 | 139 | 54 |
| SaSSy-11 | — | SaSSy97-100swapCVS(V19)74-77 | 140 | 55 |
| SaSSy-12 | | | 140 | 56 |
| SaSSy-13 | K73E | SaSSy116-124swapCVS(Vv)104-113 | 141 | 57 |
| SaSSy-14 | M9V | SaSSy116-124swapBDS137-149 | 142 | 58 |
| SaSSy-15 | N367S | SaSSy330-348swapBS302-320 | 143 | 59 |
| SaSSy-16 | K350R/N353D | SaSSy198-207swapCVS(Vv)187-195 | 144 | 60 |
| SaSSy-17 | F101L | — | 145 | 61 |
| SaSSy-18 | T192A/C195Y/S198N/E205Q/A240E/G323A/I330M/L335H/S338Y/V346A | SaSSy116-124swapCVS(V19)93-100 | 146 | 62 |
| SaSSy-19 | T5S/T192A/C195Y/S198N/E205Q/A240E/G323A/I330M/L335H/S338Y/V346A/S381G/F385L/S395A/F403Y/V433I/I465M/V502I | SaSSy116-124swapCVS(V19)93-100 | 147 | 63 |
| SaSSy-20 | Y176H/T192A/C195Y/S198N/E205Q/A240E/G323A/I330M/L335H/S338Y/S381G/S395A/F403Y/V433I/I465M/V502I | SaSSy116-124swapCVS(V19)93-100 | 148 | 64 |
| SaSSy-21 | T192A/C195Y/S198N/E205Q/A240E/G323A/L330M/L335H/S338Y/S381G/S395A/F403Y/V433I/I465M/V502I | SaSSy116-124swapCVS(V19)93-100 | 149 | 65 |

TABLE 6-continued

Exemplary Modified Santalene Synthases

| Variant Name | Mutation(s) Amino Acid Replacement(s) or Deletions | Domain Swap(s) | SEQ ID NO aa | na |
|---|---|---|---|---|
| SaSSy-22 | — | SaSSy103-115swapCVS(V19)80-92 | 150 | 66 |
| SaSSy-23 | T192A/C195Y/S198N/E205Q/A240E/ G323A/I330M/L335H/S338Y/S381G/ S395A/F403Y/V433I/I465M/V502I | SaSSy138-168swapCVS(V19)114-144 | 151 | 67 |
| SaSSy-24 | T192A/C195Y/S198N/E205Q/A240E/ G323A/I330M/L335H/S338Y/S381G/ S395A/F403Y/V433I/I465M/V502I/Q 521R | SaSSy138-168swapCVS(V19)114-144 | 152 | 68 |
| SaSSy-25 | — | SaSSy138-166swapBS109-136** | 153 | 69 |
| SaSSy-26 | — | SaSSy138-168swapCVS(V19)114-144 | 154 | 70 |
| SaSSy-27 | M9T/Q262R | — | 155 | 71 |
| SaSSy-28 | N152S/G155D/V165I/Y176F/T192A/ | — | 156 | 72 |
| SaSSy-32 | C195Y/S198N/E205Q/A240E/ G323A/I330M/L335H/S338Y/S381G/ S395A/F403Y/V433I/I465M/A473P/ V502I | | 156 | 76 |
| SaSSy-29 | N152S/G155D/V165I/Y176F/T192A/ C195Y/S198N/E205Q/A240E/ G323A/S329L/I330M/L335H/S338Y/ S381G/S395A/F403Y/V433I/I465M/ V502I | — | 157 | 73 |
| SaSSy-30 | N152S/G155D/V165I/Y176F/T192A/ C195Y/S198N/E205Q/A240E/N255S/ G323A/I330M/L335H/S338Y/S381G/ F385L/S395A/F403Y/V433I/I465M/ V502I | — | 158 | 74 |
| SaSSy-31 | N152S/G155D/V165I/Y176F/T192A/ C195Y/S198N/E205Q/A240E/ G323A/I330M/L335H/S338Y/S381G/ F385L/S395A/F403Y/V433I/I465M/ V502I | — | 159 | 75 |
| SaSSy-33 | N152S/G155D/V165I/Y176F/T192A/ C195Y/S198N/E205Q/A240E/ G323A/I330M/L335H/S338Y/S381G/ S395A/F403Y/V433I/I465M/A473E/ V502I | — | 160 | 77 |
| SaSSy-34 | N152S/G155D/V165I/Y176F/T192A/ C195Y/S198N/E205Q/A240E/ G323A/I330M/L335H/S338Y/S381G/ S395A/F403Y/V433I/I465M/A473L/ V502I | — | 161 | 78 |
| SaSSy-35 | N152S/G155D/V165I/Y176F/T192A/ C195Y/S198N/E205Q/A240E/ G323A/I330M/L335H/S338Y/S381G/ S395A/F403Y/V433I/I465M/A473V/ V502I | — | 162 | 79 |
| SaSSy-36 | N152S/G155D/V165I/Y176F/T192A/ C195Y/S198N/E205Q/A240E/ G323A/I330M/L335H/S338Y/N364D/ S381G/S395A/F403Y/V433I/I465M/ A473V/V502I | — | 163 | 80 |
| SaSSy-37 | — | SaSSy116-124swapCVS(V19)93-100 | 288 | 287 |
| SaSSy-38 | K85Q/F101L/C162V/Y176F/T192A/ C195Y/A240E/G323A/S329H/I330M/ V346A/K350R/N353D/V433I/H446R/ I465M/V502I | SaSSy1-31 swapHVS1-16/ SaSSy73-79swapBDS94-100/ SaSSy116-124swapCVS(V19)93-100/ SaSSy138-168swapCVS(V19)114-144*(C162V)/ SaSSy198-207swapCVS(Vv)187-195 | 165 | 82 |
| SaSSy-42 | K85Q/F101L/Y176F/T192A/C195Y/ A240E/G323A/S329H/I330M/V346A/ K350R/N353D/S381P/F385L/V433I/ H446R/I465M/V502I | SaSSy1-31 swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 166 | 86 |
| SaSSy-43 | M9T/D18N/T24I/T26N/A28S/K85Q/ F101L/Y176F/T192A/C195Y/A240E/ G323A/I330M/V346A/K350R/N353L/ S381G/F385L/S395A/F403Y/V433I/ H446R/I465M/C483R/V502I | SaSSy73-79swapBDS94-100/ SaSSy116-124swapCVS(V19)93-100/ SaSSy138-168swapCVS(V19)114-144**/ SaSSy198-207swapCVS(Vv)187-195 | 167 | 87 |
| SaSSy-44 | 1-33del/K85Q/F101L/Y176F/T192A/ C195Y/A240E/G323A/I330M/V346A/ | SaSSy73-79swapBDS94-100/ SaSSy116-124swapCVS(V19)93-100/ | 168 | 88 |

TABLE 6-continued

Exemplary Modified Santalene Synthases

| Variant Name | Mutation(s) Amino Acid Replacement(s) or Deletions | Domain Swap(s) | SEQ ID NO aa | na |
|---|---|---|---|---|
| | K350R/N353D/S381G/F385L/S395A/ F403Y/V433I/H446R/I465M/V502I | SaSSy138-168swapCVS(V19)114-144**/ | | |
| SaSSy-45 | K85Q/F101L/Y176F/T192A/C195Y/ K213R/A240E/G323A/S329H/I330M/ V346A/K350R/N353D/V433I/H446R/ I465M/V502I | SaSSy198-207swapCVS(Vv)187-195 SaSSy1-31swapHVS1-16/ SaSSy73-79swapBDS94-100/ SaSSy116-124swapCVS(V19)93-100/ SaSSy138-168swapCVS(V19)114-144**/ | 169 | 89 |
| SaSSy-46 | K85Q/F101L/Y176F/N183E/T192A/ C195Y/A240E/G323A/S329H/I330M/ V346A/K350R/N353D/V433I/H446R/ I465M/V502I | SaSSy198-207swapCVS(Vv)187-195 SaSSy1-31swapHVS1-16/ SaSSy73-79swapBDS94-100/ SaSSy116-124swapCVS(V19)93-100/ SaSSy138-168swapCVS(V19)114-144**/ | 170 | 90 |
| SaSSy-47 | K85Q/F101L/Y176F/T192A/C195Y/ A240E/G323A/S329H/I330M/V346A/ K350R/N353D/F363Y/V433I/H446R/ I465M/V502I | SaSSy198-207swapCVS(Vv)187-195 SaSSy1-31swapHVS1-16/ SaSSy73-79swapBDS94-100/ SaSSy116-124swapCVS(V19)93-100/ SaSSy138-168swapCVS(V19)114-144**/ | 171 | 91 |
| SaSSy-48 | A28G/K85Q/F101L/Y176F/T192A/ C195Y/A240E/G323A/S329H/I330M/ V346A/K350R/N353D/V433I/H446R/ I465M/V502I | SaSSy198-207swapCVS(Vv)187-195 SaSSy1-31swapHVS1-16/ SaSSy73-79swapBDS94-100/ SaSSy116-124swapCVS(V19)93-100/ SaSSy138-168swapCVS(V19)114-144**/ | 172 | 92 |
| SaSSy-50 | K85Q/F101L/Y176F/T192A/C195Y/ A240E/G323A/S329H/I330M/R342Q/ V346A/K350R/N353D/V433I/H446R/ I465M/V502I | SaSSy198-207swapCVS(Vv)187-195 SaSSy1-31swapHVS1-16/ SaSSy73-79swapBDS94-100/ SaSSy116-124swapCVS(V19)93-100/ SaSSy138-168swapCVS(V19)114-144**/ | 174 | 94 |
| SaSSy-51 | K85Q/F101L/Y176F/T192A/C195Y/ A240E/G323A/S329H/I330M/V346A/ K350R/N353D/V433I/A436C/H446R/ I465M/V502I | SaSSy198-207swapCVS(Vv)187-195 SaSSy1-31swapHVS1-16/ SaSSy73-79swapBDS94-100/ SaSSy116-124swapCVS(V19)93-100/ SaSSy138-168swapCVS(V19)114-144**/ | 175 | 95 |
| SaSSy-53 SaSSy-97 SaSSy-84 SaSSy-91 | K85Q/F101L/Y176F/T192A/C195Y/ K206S/A240E/G323A/S329H/I330M/ V346A/K350R/N353D/V433I/H446R/ I465M/V502I | SaSSy198-207swapCVS(Vv)187-195 SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195(K206S) | 177 177 177 177 | 97 97 128 223 |
| SaSSy-54 SaSSy-89 SaSSy-82 | K85Q/F101L/Y176F/T192A/C195Y/ K206G/A240E/G323A/S329H/I330M/ V346A/K350R/N353D/V433I/H446 R/I465M/V502I | SaSSy1-31swapHVS1-16/ SaSSy73-79swapBDS94-100/ SaSSy116-124swapCVS(V19)93-100/ SaSSy138-168swapCVS(V19)114 144**/ SaSSy198-207swapCVS(Vv)187-195(K206G) | 178 178 178 | 98 98 126 |
| SaSSy-55 SaSSy-101 | K85Q/F101L/Y176F/T192A/C195Y/ K206T/A240E/F282W/G323A/S329H/ I330M/V346A/K350R/N353D/V433I/ H446R/I465M/V502I | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195(K206T) | 179 179 | 304 304 |
| SaSSy-57 | K85Q/F101L/Y176F/T192A/C195Y/ A240E/I313L/G323A/S329H/I330M/ V346A/K350R/N353D/H404Y/V433I/ H446R/I465M/V502I | SaSSy1-31swapHVS1-16/ SaSSy73-79swapBDS94-100/ SaSSy116-124swapCVS(V19)93-100/ SaSSy138-168swapCVS(V19)114-144**/ | 181 | 101 |
| SaSSy-58 | K85Q/F101L/Y176F/T192A/C195Y/ A240E/G323A/S329H/I330M/R342H/ V346A/K350R/N353D/V433I/H446R I465M/V502I | SaSSy198-207swapCVS(Vv)187-195 SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 182 | 102 |

TABLE 6-continued

Exemplary Modified Santalene Synthases

| Variant Name | Mutation(s) Amino Acid Replacement(s) or Deletions | Domain Swap(s) | SEQ ID NO aa | na |
|---|---|---|---|---|
| SaSSy-59 | K85Q/F101L/Y176F/T192A/C195Y/ A240E/G323A/S329H/I330M/R342T/ V346A/K350R/N353D/V433I/H446R/ I465M/V502I | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 183 | 103 |
| SaSSy-60 | G70T/K85Q/F101L/Y176F/T192A/ C195Y/A240E/G323A/S329H/I330M/ V346A/K350R/N353D/V433I/H446R/ I465M/V502I | SaSSy1-31 swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 184 | 104 |
| SaSSy-63 | K85Q/F101L/Y176F/T192A/C195Y/ A240E/G323A/S329H/I330M/C345T/ V433I/H446R/I465M/V502I | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 185 | 107 |
| SaSSy-66 | | | 185 | 110 |
| SaSSy-64 | K85Q/F101L/Y176F/T192A/C195Y/ A240E/G323A/S329H/I330M/C345L/ V433I/H446R/I465M/V502I | SaSSy1-31 swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 186 | 108 |
| SaSSy-65 | K85Q/F101L/Y176F/T192A/C195Y/ A240E/G323A/S329H/I330M/C345T/ S381P/V433I/H446R/I465M/V502I | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 187 | 109 |
| SaSSy-67 | K85Q/F101L/Y176F/T192A/C195Y/ A240E/G323A/S329H/I330M/C345P/ V433I/H446R/I465M/V502I | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 188 | 111 |
| SaSSy-72 | K85Q/F101L/I112N/Y176F/T192A/ C195Y/A240E/G323A/S329H/I330M/ V346A/K350R/N353D/V433I/H446R/ I465M/V502I | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 189 | 116 |
| SaSSy-74 | K85Q/F101L/Y176F/T192A/C195Y/ A240E/G323A/S329H/I330M/V346A/ K350R/N353D/Y379I/V433I/H446R/ I465M/V502I | SaSSy1-31 swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 190 | 118 |
| SaSSy-76 | M9T/D18N/T24I/T26N/A28S/K85Q/ F101L/Y176F/T192A/C195Y/A240E/ G323A/I330M/V346A/K350R/N353D/ S381G/F385L/S395A/F403Y/V433I/ H446R/I465M/V502I | SaSSy73-79swapBDS94-100/ SaSSy116-124swapCVS(V19)93-100/ SaSSy138-168swapCVS(V19)114-144**/ SaSSy198-207swapCVS(Vv)187-195 | 191 | 120 |
| SaSSy-77 | N31A/K85Q/F101L/Y176F/T192A/C 195Y/A240E/G323A/S329H/I330M/ V346A/K350R/N353D/V433I/H446R/ I465M/V502I | SaSSy1-31swapHVS1-16(N31A)/ SaSSy73-79swapBDS94-100/ SaSSy116-124swapCVS(V19)93-100/ SaSSy138-168swapCVS(V19)114-144**/ SaSSy198-207swapCVS(Vv)187-195 | 192 | 121 |
| SaSSy-78 | K85Q/F101L/Y176F/C195Y/ A240E/G323A/S329H/I330M/V346A/ K350R/N353D/V433I/H446R/I465M/ V502I | SaSSy1-31 swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 193 | 122 |
| SaSSy-80 | | | 193 | 124 |
| SaSSy-81 | | | 193 | 125 |
| SaSSy-83 | K85Q/F101L/Y176F/T192A/C195Y/ A240E/G323A/S329H/I330M/V346A/ K350R/N353D/V433I/H446R/I465M/ V502I | SaSSy1-31swapHVS1-16/ SaSSy73-79swapBDS94-100/ SaSSy116-124swapCVS(V19)93-100/ SaSSy138-168swapCVS(V19)114-144(G155G)/ SaSSy198-207swapCVS(Vv)187-195 | 194 | 127 |

TABLE 6-continued

Exemplary Modified Santalene Synthases

| Variant Name | Mutation(s) Amino Acid Replacement(s) or Deletions | Domain Swap(s) | SEQ ID NO aa | SEQ ID NO na |
|---|---|---|---|---|
| SaSSy-85 | K85Q/F101L/Y176F/T192A/C195Y/ K206Q/A240E/G323A/S329H/I330M/ V346A/K350R/N353D/V433I/H446 R/I465M/V502I | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195(K206Q) | 195 | 129 |
| SaSSy-90 | K85Q/F101L/Y176F/T192A/C195Y/ A240E/G323A/S329H/I330M/V346A/ K350R/N353D/V433I/H446R/I465M/ E487S/V502I | SaSSy1-31 swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 245 | 222 |
| SaSSy-92 | K85Q/F101L/Y176F/T192A/C195Y/ K206T/K213R/A240E/G323A/S329H/ I330M/V346A/K350R/N353D/V433I/ H446R/I465M/V502I | SaSSy1-31 swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195(K206T) | 246 | 224 |
| SaSSy-94 | K85Q/F101L/Y176F/T192A/C195Y/ A240E/G323A/S329H/I330M/R342S/ V346A/K350R/N353D/V433I/H446R/ I465M/V502I | SaSSy1-31 swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 248 | 226 |
| SaSSy-95 | K85Q/F101L/L140Y/Y176F/T192A/ C195Y/A240E/G323A/S329H/I330M/ V346A/K350R/N353D/V433I/H446R/ I465M/V502I | SaSSy1-31swapHVS1-16/ SaSSy73-79swapBDS94-100/ SaSSy116-124swapCVS(V19)93-100/ SaSSy138-168swapCVS(V19)114-144*(L140Y)/ SaSSy198-207swapCVS(Vv)187-195 | 249 | 227 |
| SaSSy-96 | K85Q/F101L/Y176F/T192A/C195Y/ A240E/G323A/S329H/I330M/V346A/ K350R/N353D/F385L/V433I/H446R/ I465M/V502I | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 250 | 228 |
| SaSSy-102 | K85Q/F101L/Y176F/T192A/C195Y/ A240E/F282W/G323A/S329H/I330M/ V346A/K350R/N353D/V433I/H446 R/I465M/V502I | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 180 | 234 |
| SaSSy-104 | A28G/K85Q/F101L/Y176F/T192A/ C195Y/A240E/G323A/ S329H/I330M/V346A/K350R/N353D/ V433I/H446R/I465M/V502I | SaSSy1-31swapHVS1-16(A28G)/ SaSSy73-79swapBDS94-100/ SaSSy116-124swapCVS(V19)93-100(S117S)I SaSSy138-168swapCVS(V19)114-144**/ SaSSy198-207swapCVS(Vv)187-195 | 255 | 236 |
| SaSSy-111 | K85Q/F101L/I112Q/Y176F/T192A/ C195Y/A240E/G323A/S329H/I330M/ V346A/K350R/N353D/V433I/H446R/ I465M/V502I | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 266 | 262 |
| SaSSy-112 | 1-33del/K85Q/F101L/Y176F/T192A/ C195Y/A240E/G323A/S329H/I330M/ V346A/K350R/N353D/V433I/H446R/ I465M/V502I | SaSSy73-79swapBDS94-100/ SaSSy116-124swapCVS(V19)93-100/ SaSSy138-168swapCVS(V19)114-144**/ SaSSy198-207swapCVS(Vv)187-195 | 267 | 263 |
| SaSSy-113 | K85Q/F101L/S117E/Y176F/T192A/C 195Y/A240E/G323A/S329H/I330M/ V346A/K350R/N353D/V433I/H446R/ I465M/V502I | SaSSy1-31 swapHVS1-16/ SaSSy73-79swapBDS94-100/ SaSSy116-124swapCVS(V19)93-100(S117E)/ SaSSy138-168swapCVS(V19)114-144**/ SaSSy198-207swapCVS(Vv)187-195 | 243 | 264 |
| SaSSy-131 | | | 243 | 279 |
| SaSSy-116 | F74V/K85Q/F101L/F110L/Y176F/ T192A/C195Y/A240E/G323A/S329H/ I330M/V346A/K350R/N353D/V433I/ | SaSSy1-31 swapHVS1-16/ SaSSy73-79swapBDS94-100(F74V)/ SaSSy116-124swapCVS(V19)93-100/ | 164 | 93 |

TABLE 6-continued

Exemplary Modified Santalene Synthases

| Variant Name | Mutation(s) Amino Acid Replacement(s) or Deletions | Domain Swap(s) | SEQ ID NO aa | na |
|---|---|---|---|---|
| | H446R/I465M/V502I | SaSSy138-168swapCVS(V19)114-144**/ SaSSy198-207swapCVS(Vv)187-195 | | |
| SaSSy-117 | K85Q/F101L/Y176F/T192A/C195Y/ A240E/G323A/S329H/I330M/V346A/ K350R/N353D/G405S/V433I/H446R/ I465M/V502I | SaSSy1-31swapHVS1-16/ SaSSy73-79swapBDS94-100/ SaSSy116-124swapCVS(V19)93-100/ SaSSy138-168swapCVS(V19)114-144**/ | 196 | 99 |
| SaSSy-118 | K85Q/F101L/Y176F/T192A/C195Y/ A240E/L268W/A269P/G323A/S329H/ I330M/V346A/K350R/N353D/V433I/ H446R/I465M/V502I | SaSSy198-207swapCVS(Vv)187-195 SaSSy1-31swapHVS1-16/ SaSSy73-79swapBDS94-100/ SaSSy116-124swapCVS(V19)93-100/ SaSSy138-168swapCVS(V19)114-144**/ | 233 | 130 |
| SaSSy-119 | K85Q/F101L/Y176F/T192A/C195Y/ K206T/A240E/F282W/G323A/S329H/ I330M/V346A/K350R/N353D/V433I/ H446R/I465M/V502I | SaSSy198-207swapCVS(Vv)187-195 SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195(K206T) | 247 | 225 |
| SaSSy-120 | I56R/K85Q/F101L/Y176F/T192A/ C195Y/A240E/G323A/S329H/I330M/ V346A/K350R/N353D/V433I/H446R/ I465M/V502I | SaSSy1-31 swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 251 | 229 |
| SaSSy-121 | I56K/K85Q/F101L/Y176F/T192A/ C195Y/A240E/G323A/S329H/I330M/ V346A/K350R/N353D/V433I/H446R/ I465M/V502I | SaSSy1-31 swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 252 | 230 |
| SaSSy-122 | K85Q/F101L/S170A/Y176F/T192A/ C195Y/A240E/G323A/S329H/I330M/ V346A/K350R/N353D/V433I/H446R/ I465M/V502I | SaSSy1-31 swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 253 | 231 |
| SaSSy-123 | K85Q/F101L/Y176F/T192A/C195Y/ A240E/G323A/S329H/I330M/V346A/ K350R/N353D/V433I/H446R/I465M/ V502I/T548A | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 254 | 232 |
| SaSSy-124 | K85Q/F101L/Y176F/T192A/C195Y/ A240E/G323A/S329H/I330M/V346A/ K350R/N353D/V433I/H446R/I465M/ V502I/T548S | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 256 | 235 |
| SaSSy-125 | K85Q/F101L/Y176F/T192A/C195Y/ A240E/G323A/S329H/I330M/V346A/ K350R/N353D/T408A/V433I/H446R/ I465M/S480A/V502I | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 257 | 237 |
| SaSSy-126 | K85Q/F101L/Y176F/T192A/C195Y/ A240E/G323A/S329H/I330M/V346A/ K350R/N353D/V433I/H446R/I465M/ V502I/S518E | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 259 | 238 |
| SaSSy-127 | L64Q/K85Q/F101L/Y176F/T192A/ C195Y/A240E/G323A/S329H/I330M/ V346A/K350R/N353D/V433I/H446R/ I465M/V502I | SaSSy1-31 swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 260 | 240 |
| SaSSy-128 | L64E/K85Q/F101L/Y176F/T192A/ C195Y/A240E/G323A/S329H/I330M/ | SaSSy1-31swapHVS1-16/ SaSSy73-79swapBDS94-100/ | 261 | 241 |

TABLE 6-continued

Exemplary Modified Santalene Synthases

| Variant Name | Mutation(s) Amino Acid Replacement(s) or Deletions | Domain Swap(s) | SEQ ID NO aa | na |
|---|---|---|---|---|
| | V346A/K350R/N353D/V433I/H446R/ I465M/V502I | SaSSy116-124swapCVS(V19)93-100/ SaSSy138-168swapCVS(V19)114-144**/ SaSSy198-207swapCVS(Vv)187-195 | | |
| SaSSy-129 | K85Q/F101L/Y176F/T192A/C195Y/ A240E/G323A/S329H/I330M/V346A/ K350R/N353D/V433I/H446R/L452I/ I465M/V502I | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 | 277 | 242 |
| SaSSy-130 | K85Q/F101L/S117D/Y176F/T192A/ C195Y/A240E/G323A/S329H/I330M/ V346A/K350R/N353D/V433I/H446R/ I465M/V502I | SaSSy1-31swapHVS1-16/ SaSSy73-79swapBDS94-100/ SaSSy116-124swapCVS(V19)93-100(S117D)/ SaSSy138-168swapCVS(V19)114-144**/ SaSSy198-207swapCVS(Vv)187-195 | 283 | 278 |
| SaSSy-132 | K85Q/F101L/S117N/Y176F/T192A/ C195Y/A240E/G323A/S329H/I330M/ V346A/K350R/N353D/V433I/H446R/ I465M/V502I | SaSSy1-31swapHVS1-16/ SaSSy73-79swapBDS94-100/ SaSSy116-124swapCVS(V19)93-100(S117N)/ SaSSy138-168swapCVS(V19)114-144**/ SaSSy198-207swapCVS(Vv)187-195 | 285 | 280 |
| SaSSy-133 | K85Q/F101L/Y176F/T192A/C195Y/ K206T/K213R/A240E/G323A/S329H/ I330M/V346A/K350R/N353D/Y379I/ F385L/S395A/F403Y/V433I/H446R/ I465M/E487A/V502I | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195 (K206T) | 286 | 281 |
| SaSSy-134 | M9T/D18N/T24I/T26N/A28S/K85Q/ F101L/Y176F/T192A/C195Y/A240E/ G323A/S329H/I330M/R342G/V346A/ K350R/N353D/V433I/H446R/I465M/ V502I | SaSSy73-79swapBDS94-100/ SaSSy116-124swapCVS(V19)93-100/ SaSSy138-168swapCVS(V19)114-144**/ SaSSy198-207swapCVS(Vv)187-195 | 244 | 282 |
| SaSSy-135 | K85Q/F101L/Y176F/N183K/T192A/ C195Y/K206G/A240E/F282W/G323 A/S329H/I330M/V346A/K350R/N35 3D/V433I/H446R/I465M/V502I | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195(K206G) | 309 | 306 |
| SaSSy-136 | K85Q/F101L/Y176F/N183K/T192A/ C195Y/K206S/A240E/F282W/G323A/ S329H/I330M/V346A/K350R/N353 D/V433I/H446R/I465M/V502I | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195(K206S) | 310 | 307 |
| SaSSy-137 | K85Q/F101L/Y176F/N183D/T192A/ C195Y/K206A/A240E/F282W/G323 A/S329H/I330M/V346A/K350R/N35 3D/V433I/H446R/I465M/V502I | SaSSy1-31swapHVS1-16/ SaSSy73-79swapBDS94-100/ SaSSy116-124swapCVS(V19)93-100/ SaSSy138-168swapCVS(V19)114-144**/ SaSSy198-207swapCVS(Vv)187-195(K206A) | 311 | 308 |

Among the modified santalene synthase polypeptides provided herein are those whose sequence is set forth in any of SEQ ID NOS: 131, 133, 136-138, 140-142, 146, 147, 148, 151, 152, 154, 164, 165, 166, 168-172, 174, 175, 177-179, 182-190, 192-196, 233, 243-257, 259-261, 266, 277, 283, 285, 286, 288 and 309-311 or in a variant thereof that exhibits at least 85%, 86%, 87%, 88%, 89%, 90%, 91%, 92%, 93%, 94%, 95%, 96%, 97%, 98%, 99% or more sequence identity to any of SEQ ID NOS: 131, 133, 136-138, 140-142, 146, 147, 148, 151, 152, 154, 164, 165, 166, 168-172, 174, 175, 177-179, 182-190, 192-196, 233, 243-257, 259-261, 266, 277, 283, 285, 286, 288 and 309-311, and that contains the amino acid modification(s). Also provided herein are nucleic acid molecules that encode any of the above modified santalene synthase polypeptides that have a sequence of nucleotides set forth in any of SEQ ID NOS: 45, 47, 50-53, 55-58, 62-64, 67, 68, 70, 81-86, 88-100, 102-119, 121-130, 219, 220, 222-232, 235-238, 240-242, 262, 264, 265, 278-282, 287, 304 or 306-308 or in a variant thereof that exhibits at least 85%, 86%, 87%, 88%, 89%, 90%, 91%, 92%, 93%, 94%, 95%, 96%, 97%, 98%, 99% or more sequence identity to any of SEQ ID NOS: 45, 47, 50-53, 55-58, 62-64, 67, 68, 70, 81-86, 88-100, 102-119, 121-130, 219, 220, 222-232, 235-238, 240-242, 262, 264, 265, 278-282, 287, 304 or 306-308, and that encodes a modified santalene synthase that contains the amino acid modification(s). Such modified santalene synthase polypeptides, including those encoded by such nucleic acid molecules, exhibit increased total terpene production to catalyze the production of at least 105%, 106%, 107%, 108%, 109%, 110%, 115%, 120%, 125%, 130%, 135%, 140%, 145%, 150%, 160%, 170%, 180%, 200%, 250%, 300%, 350%, 400%, 500% or more of the amount of total terpene products (e.g., α-santalene, β-santalene, α-exo-bergamotene) produced from FPP compared to the santalene synthase polypeptide not containing the modification(s) (i.e. the unmodified santalene synthase), such as the santalene synthase encoded by the sequence of nucleotides set forth in SEQ ID NO:2 or the codon-optimized variant thereof set forth in SEQ ID NO:3.

Also provided herein are modified santalene synthase polypeptides set forth in any of SEQ ID NOS: 131-136, 139-142, 146-153, 164-169, 172, 177-179, 180-184, 186, 188-194, 196, 233, 243, 244, 245, 247, 249, 250, 254-257, 259-261, 267, 277, 283, 285, 286, 288 or 309-311, or a variant thereof that exhibits at least 85%, 86%, 87%, 88%, 89%, 90%, 91%, 92%, 93%, 94%, 95%, 96%, 97%, 98%, 99% or more sequence identity to any of SEQ ID NOS: 131-136, 139-142, 146-153, 164-169, 172, 177-179, 180-184, 186, 188-194, 196, 233, 243, 244, 245, 247, 249, 250, 254-257, 259-261, 267, 277, 283, 285, 286, 288 or 309-311, and that contains the amino acid modification(s). Also provided herein are nucleic acid molecules that encode any of the above modified santalene synthase polypeptides that have the sequence of nucleotides set forth in any of SEQ ID NOS: 3, 44, 45-58, 62-69, 81-89, 92, 93, 96-104, 105, 106, 108, 111-128, 130, 219, 220, 222, 223, 225, 227, 228, 232, 234, 235, 236, 237, 238, 240-242, 263, 264, 265, 278-282, 287, 304 or 306-308, or a variant thereof that exhibits at least 85%, 86%, 87%, 88%, 89%, 90%, 91%, 92%, 93%, 94%, 95%, 96%, 97%, 98%, 99% or more sequence identity to any of SEQ ID NOS: 3, 44, 45-58, 62-69, 81-89, 92, 93, 96-104, 105, 106, 108, 111-128, 130, 219, 220, 222, 223, 225, 227, 228, 232, 234, 235, 236, 237, 238, 240-242, 263, 264, 265, 278-282, 287, 304 or 306-308, and that encodes a modified santalene synthase that contains the amino acid modification(s). Such modified santalene synthase polypeptides, including those encoded by such nucleic acid molecules, exhibit catalytic activity to produce an altered product profile to result in production of at least one terpene product (e.g., α-santalene, β-santalene and/or α-exo-bergamotene) that is altered (increased or decreased) by at least 1%, 2%, 3%, 4%, 5%, 6%, 7%, 8%, 9%, 10%, 15%, 20%, 25%, 30%, 35%, 40%, 50%, 60%, 70%, 80%, 90% or more compared to same product produced in a host cell from FPP by the corresponding santalene synthase not containing modification(s) (i.e. the unmodified santalene synthase), such as the santalene synthase encoded by the sequence of nucleotides set forth in SEQ ID NO:2 or the codon-optimized variant thereof set forth in SEQ ID NO:3.

3. Fusion Proteins and Other Forms of Additional Modifications

Modifications in a santalene synthase polypeptide also can be made to a santalene synthase polypeptide that also contains other modifications, including modifications of the primary sequence and modifications not in the primary sequence of the polypeptide. For example, modification described herein can be in a santalene synthase polypeptide that is a fusion polypeptide or chimeric polypeptide. For example, any of the modified santalene synthase polypeptides herein, or active fragment thereof, can be provided as a hybrid or fusion with a different santalene synthase polypeptide or a different terpene synthase polypeptide. In other cases, the modified santalene synthase polypeptide can be provided as a fusion protein with an FPP, cytochrome P450 oxidase (e.g., cytochrome P450 santalene oxidase or cytochrome P450 bergamotene oxidase) or a cytochrome P450 reductase.

D. Production of Modified Santalene Synthase Polypeptides and Encoding Nucleic Acid Molecules Santalene synthase polypeptides and active fragments thereof can be obtained by methods known in the art for recombinant protein generation and expression. Such santalene synthase polypeptides can be used to produce santalenes (e.g., α and/or β santalene) and bergamotene in a host cell from which the santalene synthase polypeptide is expressed or in vitro following purification of the santalene synthase polypeptide. For example, a santalene synthase polypeptide can be used to produce santalenes and bergamotene from a suitable acyclic pyrophosphate precursor, such as FPP, in a host cell in which the santalene synthase is expressed.

Any method known to one of skill in the art for identification of nucleic acids that encode desired genes can be used to obtain nucleic acid encoding a santalene synthase polypeptide. For example, nucleic acid encoding an unmodified or wild type santalene synthase can be obtained using well known methods from a plant source, such as *Santalum album*. Modified santalene synthases then can be engineered using any method known in the art for introducing mutations into unmodified polypeptides, including any method described herein, such as random mutagenesis of the encoding nucleic acid by error-prone PCR, site-directed mutagenesis, overlap PCR, or other recombinant methods. Alternatively, nucleic acid encoding a wild-type, unmodified or modified santalene synthase can be generated synthetically, using solid-phase chemical synthesis. In some examples, nucleic acid is generated that is codon-optimized for protein expression in a particular host cell, such as a yeast cell.

The nucleic acids encoding the polypeptides then can be introduced into a host cell to be expressed heterologously. In other examples, santalene synthase polypeptides are produced synthetically, such as using sold phase or solution phase peptide synthesis.

1. Isolation or Generation of Nucleic Acid Encoding Santalene Synthases

Nucleic acids encoding santalene synthases can be cloned or isolated using any available methods known in the art for cloning and isolating nucleic acid molecules. Such methods include PCR amplification of nucleic acids and screening of libraries, including nucleic acid hybridization screening. In some examples, methods for amplification of nucleic acids can be used to isolate nucleic acid molecules encoding a santalene synthase polypeptide, including, for example, polymerase chain reaction (PCR) methods. A nucleic acid containing material can be used as a starting material from which a santalene synthase-encoding nucleic acid molecule can be isolated. For example, DNA and mRNA preparations from *Santalum* species, including, but not limited to, *Santalum album* can be used to obtain santalene synthase genes. Nucleic acid libraries also can be used as a source of starting material. Primers can be designed to amplify a santalene synthase-encoding molecule. For example, primers can be designed based on known nucleic acid sequences encoding a santalene synthase. Nucleic acid molecules generated by amplification can be sequenced and confirmed to encode a santalene synthase polypeptide. The nucleic acid molecules provided herein can be used to identify related nucleic acid molecules in other species.

Additional nucleotide sequences can be joined to a santalene synthase-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a santalene synthase-encoding nucleic acid molecule. Still further, nucleic acid encoding other moieties or domains also can be included so that the resulting synthase is a fusion protein; for example, nucleic acids encoding other enzymes, such as FPP synthase or cytochrome P450 oxidase, or protein purification tags, such as His or Flag tags.

2. Generation of Modified Nucleic Acid

Nucleic acid encoding a modified santalene synthase polypeptide can be prepared or generated using any method known in the art to effect mutation. Methods for modification include standard rational and/or random mutagenesis of encoding nucleic acid molecules (using e.g., error prone PCR, random site-directed saturation mutagenesis, DNA shuffling or rational site-directed mutagenesis, such as, for example, mutagenesis kits (e.g., QuikChange available from Stratagene)). In addition, routine recombinant DNA techniques can be used to generate nucleic acids encoding polypeptides that contain heterologous amino acid. For example, nucleic acid encoding chimeric polypeptides or polypeptides containing heterologous amino acid sequence, can be generated using a two-step PCR method, Gibson assembly and/or using restriction enzymes and cloning methodologies for routine subcloning of the desired chimeric polypeptide components. Other methodologies that can be employed include, for example, direct recombination in yeast.

Once generated, the nucleic acid molecules can be expressed in cells to generate modified santalene synthase polypeptides using any method known in the art. The modified santalene synthase polypeptides then can be assessed by screening for a desired property or activity, for example, for the ability to produce a terpene from an acyclic pyrophosphate terpene precursor. In particular examples, modified santalene synthase polypeptides with desired properties are generated by mutation and screened for a property in accord with the examples exemplified herein. Typically, the modified santalene synthase polypeptides produce santalenes or bergamotene from FPP.

3. Fusion Proteins

Fusion proteins containing a santalene synthase polypeptide and one or more other polypeptides also are provided. Linkage of a santalene synthase polypeptide with another polypeptide can be effected directly or indirectly via a linker. Fusion of a santalene synthase to another polypeptide can be to the N- or C-terminus of the santalene synthase polypeptide. In one example, linkage can be by chemical linkage, such as via heterobifunctional agents or thiol linkages or other such linkages. Fusion also can be effected by recombinant means.

For example, a fusion protein can be produced by standard recombinant techniques. For example, DNA fragments coding for the different polypeptide sequences can be ligated together in-frame in accordance with conventional techniques, e.g., by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments that can subsequently be annealed and reamplified to generate a chimeric gene sequence (see, e.g., Ausubel et al. (eds.) Current Protocols in Molecular Biology, John Wiley & Sons, 1992). Moreover, many expression vectors are commercially available that already encode a fusion moiety (e.g., a GST polypeptide). In other cases, a gene encoding a fusion of interest (e.g., cytochrome P450 oxidase or cytochrome P450 reductase) can be cloned into an expression vector such that the fusion moiety is linked in frame to a modified santalene synthase polypeptide-encoding nucleic acid molecule.

4. Vectors and Cells

For recombinant expression of one or more of the santalene synthase polypeptides provided herein, the nucleic acid containing all or a portion of the nucleotide sequence encoding the synthase can be inserted into an appropriate expression vector, i.e., a vector that contains the necessary elements for the transcription and translation of the inserted protein coding sequence. Depending upon the expression system used, the necessary transcriptional and translational signals also can be supplied by the native promoter for a santalene synthase gene, and/or their flanking regions. The vector can be a shuttle vector that permits expression in at least two different host species, either both prokaryotic or in both eukaryotes and prokaryotes (e.g., *E. coli* and yeast). Thus, also provided herein are vectors that contain nucleic acid encoding any santalene synthase polypeptide provided herein. Exemplary vectors that are suitable for various expression systems are described in the subsections below.

Any method known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding a santalene synthase polypeptide, or domains, derivatives, fragments or homologs thereof, can be regulated by a second nucleic acid sequence so that the genes or fragments thereof are expressed in a host transformed with the recombinant DNA molecule(s). For example, expression of the proteins can be controlled by any promoter/enhancer known in the art. In one embodiment, the promoter is not native to the genes for a santalene synthase protein. Promoters that can be used include but are not limited to prokaryotic, yeast, mammalian and plant promoters. The type of promoter depends upon the expression system used, described in more detail below.

In one embodiment, a vector is used that contains a promoter operably linked to nucleic acids encoding a santalene synthase polypeptide or modified santalene synthase polypeptide, or a domain, fragment, derivative or homolog, thereof, one or more origins of replication, and optionally, one or more selectable markers (e.g., an antibiotic resistance gene). Vectors and systems for expression of santalene synthase polypeptides are described.

Cells, including prokaryotic and eukaryotic cells, containing the vector also are provided. Also provided are host cells containing nucleic acid molecules encoding santalene synthase polypeptides provided herein. Such cells and host cells include bacterial cells, yeast cells, fungal cells, Archea, plant cells, insect cells and animal cells. In particular examples, the cells or host cells are yeast cells, such as *Saccharomyces cerevisiae* or *Pichia pastoris* cells. In particular examples, the cells or host cells are *Saccharomyces cerevisiae* cells that express an acyclic pyrophosphate terpene precursor, such as farnesyl diphosphate (FPP). In some examples, the cells or host cells containing a santalene synthase provided herein can be modified to produce more FPP than an unmodified cell.

The cells are used to produce a santalene synthase polypeptide by growing the above-described cells under conditions whereby the encoded santalene synthase is expressed by the cell. In some examples, the santalene synthase polypeptide is heterologous to the cell. In some examples, a santalene synthase, a cytochrome P450 santalene oxidase and a cytochrome P450 reductase are expressed thereby converting the acyclic pyrophosphate terpene precursor FPP to santalol. In other examples, a santalene synthase, a cytochrome P450 bergamotene oxidase and a cytochrome P450 reductase are expressed thereby converting the acyclic pyrophosphate terpene precursor FPP to bergamotol.

5. Expression Systems

Santalene synthase polypeptides can be produced by any methods known in the art for protein production including in vitro and in vivo methods such as, for example, the introduction of nucleic acid molecules encoding the santalene synthases into a host cell or host plant for in vivo production or expression from nucleic acid molecules encoding the santalene synthases in vitro. Santalene synthase polypeptides can be expressed in any organism suitable to produce the required amounts and forms of a synthase polypeptide. Expression hosts include prokaryotic and eukaryotic organisms such as *E. coli*, yeast, plants, insect cells and mammalian cells, including human cell lines and transgenic animals. Expression hosts can differ in their protein production levels as well as the types of post-translational modifications that are present on the expressed proteins. The choice of expression host can be made based on these and other factors, such as regulatory and safety considerations, production costs and the need and methods for purification.

Expression in eukaryotic hosts can include expression in yeast such as those from the *Saccharomyces* genus (e.g., *Saccharomyces cerevisiae*) and *Pichia* genus (e.g., *Pichia pastoris*), insect cells such as *Drosophila* cells and *Lepidopteran* cells, plants and plant cells such as citrus, tobacco, corn, rice, algae, and lemna. Eukaryotic cells for expression also include mammalian cells lines such as Chinese hamster ovary (CHO) cells and baby hamster kidney (BHK) cells. Eukaryotic expression hosts also include production in transgenic animals, for example, including production in serum, milk and eggs.

Many expression vectors are available and known to those of skill in the art for the expression of a santalene synthase polypeptide. The choice of expression vector is influenced by the choice of host expression system. Such selection is well within the level of skill of the skilled artisan. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vectors in the cells.

Expression vectors also can be shuttle vectors that permit propagation in two different hosts. For example, vectors include yeast shuttle vectors that contain components allowing for the replication and selection in both *E. coli* cells and yeast cells. The *E. coli* component of a yeast shuttle vector can include an origin of replication and a selectable marker, such as an antibiotic resistance, for example, resistance to ampicillin or beta-lactamase. The yeast component can include an autonomously replicating sequence (ARS), a yeast centromere (CEN) and a yeast selectable marker, for example ura3 or Leu. Exemplary yeast shuttle vectors include those pAlx48-16.2 or pAlx72-5.4 exemplified in the Examples herein.

Santalene synthase polypeptides also can be used or expressed as protein fusions. For example, a fusion can be generated to add additional functionality to a polypeptide. Examples of fusion proteins include, but are not limited to, fusions of a signal sequence, a tag such as for localization, e.g., a $his_6$ tag or a myc tag, or a tag for purification, for example, a GST fusion, GFP fusion or CBP fusion, and a sequence for directing protein secretion and/or membrane association.

Methods of using santalene synthase polypeptides to produce terpene products, for example as described in Section E below, can include co-expression of an acyclic pyrophosphate terpene precursor, such as FPP, in the host cell. In some instances, the host cell naturally expresses FPP. Such a cell can be modified to express greater quantities of FPP (see e.g., U.S. Pat. Nos. 6,531,303, 6,689,593, 7,838, 279 and 7,842,497). In other instances, a host cell that does not naturally produce FPP is modified genetically to produce FPP by co-expression of heterologous FPP in the host cell.

a. Prokaryotic Cells

Prokaryotes, especially *E. coli*, provide a system for producing large amounts of the santalene synthase polypeptides provided herein. Transformation of *E. coli* is a simple and rapid technique well known to those of skill in the art. Exemplary expression vectors for transformation of *E. coli* cells, include, for example, the pGEM expression vectors, the pQE expression vectors, and the pET expression vectors (see, U.S. Pat. No. 4,952,496; available from Novagen, Madison, Wis.; see, also literature published by Novagen describing the system). Such plasmids include pET 11a, which contains the T7lac promoter, T7 terminator, the inducible *E. coli* lac operator, and the lac repressor gene; pET 12a-c, which contains the T7 promoter, T7 terminator, and the *E. coli* ompT secretion signal; pET 15b and pET19b (Novagen, Madison, Wis.), which contain a His-Tag™ leader sequence for use in purification with a His column and a thrombin cleavage site that permits cleavage following purification over the column, the T7-lac promoter region and the T7 terminator; pACYC-Duet (Novagen, Madison, Wis.; SEQ ID NO:45). Shuttle vectors, such as yeast shuttle vectors containing an *E. coli* origin of replication and a selectable marker (e.g., antibiotic resistance) also can be employed, e.g., pAlx48-16.2 or pAlx72-5.4 shuttle vectors, as described elsewhere herein.

Expression vectors for *E. coli* can contain inducible promoters that are useful for inducing high levels of protein expression and for expressing proteins that exhibit some toxicity to the host cells. Exemplary prokaryotic promoters include, for example, the β-lactamase promoter (Jay et al., (1981) *Proc. Natl. Acad. Sci. USA* 78:5543) and the tac promoter (DeBoer et al., (1983) *Proc. Natl. Acad. Sci. USA* 80:21-25); see also Gilbert and Villa-Komaroff "Useful Proteins from Recombinant Bacteria": in Scientific American 242:74-94 (1980)). Examples of inducible promoters include the lac promoter, the trp promoter, the hybrid tac promoter, the T7 and SP6 RNA promoters and the temperature regulated $\lambda P_L$ promoter.

Santalene synthase polypeptides can be expressed in the cytoplasmic environment of *E. coli*. The cytoplasm is a reducing environment and for some molecules, this can result in the formation of insoluble inclusion bodies. Reducing agents such as dithiothreitol and β-mercaptoethanol and denaturants (e.g., such as guanidine-HCl and urea) can be used to resolubilize the proteins. An alternative approach is the expression of santalene synthase polypeptides in the periplasmic space of bacteria which provides an oxidizing environment and chaperonin-like proteins and disulfide isomerases, leading to the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility. Typically, temperatures between 25° C. and 37° C. are used. Mutations also can be used to increase solubility of expressed proteins. Typically, bacteria produce aglycosylated proteins.

b. Yeast Cells

Yeast systems, such as, but not limited to, those from the *Saccharomyces* genus (e.g., *Saccharomyces cerevisiae*), *Schizosaccharomyces pombe*, *Yarrowia lipolytica*, *Kluyveromyces lactis*, and *Pichia pastoris* can be used to express the santalene synthase polypeptides provided herein. As described in Section E below, yeast expression systems also can be used to produce terpenes whose reactions are catalyzed by the synthases. Yeast can be transformed with episomal replicating vectors or by stable chromosomal integration by homologous recombination. In some examples, inducible promoters are used to regulate gene expression. Exemplary promoter sequences for expression of santalene synthase polypeptides in yeast include, among others, promoters for metallothionine, 3-phosphoglycerate kinase (Hitzeman et al. (1980) *J. Biol. Chem.* 255:2073), or other glycolytic enzymes (Hess et al. (1968) *J. Adv. Enzyme Reg.* 7:149; and Holland et al. (1978) *Biochem.* 17:4900), such as enolase, glyceraldehyde phosphate dehydrogenase, hexokinase, pyruvate decarboxylase, phosphofructokinase, glucose phosphate isomerase, 3-phosphoglycerate mutase, pyruvate kinase, triosephosphate isomerase, phosphoglucose isomerase, and glucokinase.

Other suitable vectors and promoters for use in yeast expression are further described in Hitzeman, EPA-73,657 or in Fleer et al. (1991) *Gene,* 107:285-195; and van den Berg et al. (1990) *Bio/Technology,* 8:135-139. Another alternative includes, but is not limited to, the glucose-repressible ADH2 promoter described by Russell et al. (*J. Biol. Chem.* 258:2674, 1982) and Beier et al. (*Nature* 300:724, 1982), or a modified ADH1 promoter. Shuttle vectors replicable in yeast and *E. coli* can be constructed by, for example, inserting DNA sequences from pBR322 for selection and replication in *E. coli* (Amp$^r$ gene and origin of replication) into the above-described yeast vectors. Exemplary yeast shuttle vectors are exemplified herein and include, but are not limited to, pAlx48-16.2 or pAlx72-5.4.

Yeast expression vectors can include a selectable marker such as LEU2, TRP1, HIS3, and URA3 for selection and maintenance of the transformed DNA. Exemplary vectors include pESC-Leu, pESC-Leu2D, pESC-His and pYEDP60. Proteins expressed in yeast are often soluble and co-expression with chaperonins, such as Bip and protein disulfide isomerase, can improve expression levels and solubility. Additionally, proteins expressed in yeast can be directed for secretion using secretion signal peptide fusions such as the yeast mating type alpha-factor secretion signal from *Saccharomyces cerevisiae* and fusions with yeast cell surface proteins such as the Aga2p mating adhesion receptor or the *Arxula adeninivorans* glucoamylase. A protease cleavage site (e.g., the Kex-2 protease) can be engineered to remove the fused sequences from the polypeptides as they exit the secretion pathway.

As described herein, the modified santalene synthases provided herein can be expressed and produced in host cells to produce terpene products (e.g., α-santalene, β-santalene, α-exo-bergamotene and/or other terpenes) in the host cell from any suitable acyclic pyrophosphate terpene precursor, such as FPP. Yeast naturally express the required proteins, including FPP synthase (ERG20; which can produce FPP) for the mevalonate-dependent isoprenoid biosynthetic pathway. Thus, expression of the santalene synthase polypeptides provided herein, in yeast cells can result in the production of sesquiterpenes, such as santalenes and bergamotenes from FPP.

In some cases, yeast cells can be modified to express increased levels of FPP. For example, yeast cells can be modified to produce less squalene synthase or less active squalene synthase (e.g., erg9 mutants; see e.g., U.S. Pat. Nos. 6,531,303 and 6,689,593). This results in accumulation of FPP in the host cell at higher levels compared to wild type yeast cells, which in turn can result in increased yields of sesquiterpenes and sesquiterpenoids (e.g., santalenes and bergamotenes, and santalols and bergamotols). In another example, yeast cells can be modified to produce more FPP synthase by introduction of heterologous FPP synthase gene from another prokaryotic or eukaryotic cell, such as from *E. coli*, yeast (e.g., *S. cerevisiae*), plant (e.g., a *Santalum*) or other cells. For example, a yeast cell can be modified by introduction of SaFPPS from *Santalum album* (SEQ ID NO:176).

In some examples, the native FPP gene in such yeast can be deleted. Other modifications that enable increased production of FPP in yeast include, for example, but are not limited to, modifications that increase production of acetyl CoA, inactivate genes that encode enzymes that use FPP and GPP as substrate and overexpress HMG-CoA reductases, as described in U.S. Pat. No. 7,842,497. Exemplary modified yeast cells include, but are not limited to, YPH499 (MATa, ura3-52, lys2-801, ade2-101, trp1-Δ63, his3-Δ200, leu2-Δ1), WAT11 (MATa, ade2-1, his3-11, -15; leu2-3, -112, ura3-1, canR, cyr+; containing chromosomally integrated *Arabidopsis* NADPH-dependent P450 reductase ATR1; see Pompon et al. (1995) *Toxicol Lett* 82-83:815-822; Ro et al. (2005) *Proc Natl Acad Sci USA* 102:8060-8065); and BY4741 (MATa, his3Δ1, leu2Δ0, met15Δ0, ura3Δ0; ATCC #201388), modified *Saccharomyces cerevisiae* strains CALI5-1 (ura3, leu2, his3, trp1, Δ erg9::HIS3, HMG2cat/TRP1::rDNA, dpp1, sue), ALX7-95 (ura3, his3, trp1, Δerg9::HIS3, HMG2cat/TRP1::rDNA, dpp1 sue), ALX11-30 (ura3, trp1, erg9$^{def}$25, HMG2cat/TRP1::rDNA, dpp1, sue), which are known and described in one or more of U.S. Pat. Nos. 6,531,303, 6,689,593, 7,838,279, 7,842,497, and U.S. Pat. publication Nos. 20040249219 and 20110189717.

c. Plants and Plant Cells

Transgenic plant cells and plants can be used for the expression of santalene synthase polypeptides provided herein. Expression constructs are typically transferred to plants using direct DNA transfer such as microprojectile bombardment and PEG-mediated transfer into protoplasts, and with *agrobacterium*-mediated transformation. Expression vectors can include promoter and enhancer sequences, transcriptional termination elements, and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline synthase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce proteins (see, for example, Mayfield et al. (2003) *Proc Natl Acad Sci USA* 100:438-442). Transformed plants include, for example, plants selected from the genera *Nicotiana, Solanum, Sorghum, Arabidopsis, Medicago* (alfalfa), *Gossypium* (cotton), *Brassica* (rape), *Artemisia, Salvia* and *Mentha*. In some examples, the plant belongs to the species of *Nicotiana tabacum*, and is transformed with vectors that overexpress a santalene synthase, such as those described in U.S. Pat. Pub. No. 20090123984 and U.S. Pat. No. 7,906,710.

d. Insects and Insect Cells

Insects and insect cells, particularly a baculovirus expression system, can be used for expressing santalene synthase polypeptides provided herein (see, for example, Muneta et al. (2003) *J. Vet. Med. Sci.* 65(2):219-223). Insect cells and insect larvae, including expression in the haemolymph, express high levels of protein and are capable of most of the post-translational modifications used by higher eukaryotes. Baculoviruses have a restrictive host range which improves the safety and reduces regulatory concerns of eukaryotic expression. Typically, expression vectors use a promoter such as the polyhedrin promoter of baculovirus for high level expression. Commonly used baculovirus systems include baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugiperda* (see, e.g., Mizutani and Ohta (1998) *Plant Physiology* 116:357-367), *Pseudaletia unipuncta* (A7S) and *Danaus plexippus* (DpN1). For high level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems.

An alternative expression system in insect cells is the use of stably transformed cells. Cell lines such as the Schnieder 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

e. Mammalian Expression

Mammalian expression systems can be used to express santalene synthase polypeptides provided herein and also can be used to produce terpenes whose reactions are catalyzed by the synthases. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. Such vectors often include transcriptional promoter-enhancers for high level expression, for example the SV40 promoter-enhancer, the human cytomegalovirus (CMV) promoter, and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha-fetoprotein, alpha 1-antitrypsin, beta-globin, myelin basic protein, myosin light chain-2 and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase and thymidine kinase. Fusion with cell surface signaling molecules such as TCR-ζ and Fc$_\epsilon$RI-γ can direct expression of the proteins in an active state on the cell surface.

Many cell lines are available for mammalian expression including mouse, rat human, monkey, and chicken and hamster cells. Exemplary cell lines include, but are not limited to, BHK (i.e. BHK-21 cells), 293-F, CHO, CHO Express (CHOX; Excellgene), Balb/3T3, HeLa, MT2, mouse NS0 (non-secreting) and other myeloma cell lines, hybridoma and heterohybridoma cell lines, lymphocytes, fibroblasts, Sp2/0, COS, NIH3T3, HEK293, 293S, 293T, 2B8, and HKB cells. Cell lines also are available adapted to serum-free media which facilitates purification of secreted proteins from the cell culture media. One such example is the serum free EBNA-1 cell line (Pham et al. (2003) *Biotechnol. Bioeng.* 84:332-42).

6. Purification

Methods for purification of santalene synthase polypeptides from host cells depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary the proteins can be extracted and further purified using standard methods in the art.

Santalene synthase polypeptides can be purified using standard protein purification techniques known in the art including but not limited to, SDS-PAGE, size fraction and size exclusion chromatography, ammonium sulfate precipitation, chelate chromatography and ionic exchange chromatography. Expression constructs also can be engineered to add an affinity tag such as a myc epitope, GST fusion or $His_6$ and affinity purified with myc antibody, glutathione resin, and Ni-resin, respectively, to a protein. Purity can be assessed by any method known in the art including gel electrophoresis and staining and spectrophotometric techniques.

E. Methods of Producing Terpenes and Terpenoid Using Santalene Synthase Polypeptides and Encoding Nucleic ACID MOLECULES Provided herein are methods using the modified santalene synthase polypeptides, and encoding nucleic acid molecules, to catalyze the production of terpenes, including monoterpenes, sesquiterpenes and diterpenes, from any suitable acyclic pyrophosphate terpene precursor, including geranyl diphosphate (GPP), farnesyl diphosphate (FPP) and geranylgeranyl diphosphate (GGPP). Typically, the modified santalene synthase polypeptides provided herein, including modified santalene synthase polypeptides encoded by any of the nucleic acid molecules provided herein, produce terpene products from FPP. The methods provided herein can be used to produce any terpene product known to be produced by a santalene synthase (e.g., set forth in any of SEQ ID NOS:1, 10, 12, 14 or 27-43), albeit in increased amounts and/or with an altered product profile as described herein.

For example, the modified santalene synthase polypeptides, including modified santalene synthase polypeptides encoded by nucleic acid molecules provided herein, can catalyze the production of any one or more or all of α-santalene, β-santalene, α-exo-bergamotene, (E)-β-farnesene and/or (E,E)-α-farnesene or stereoisomers thereof (see FIGS. 1A and 1B). In particular, the modified santalene synthase polypeptides, including modified santalene synthase polypeptides encoded by nucleic acid molecules provided herein, catalyze the production of any one or more or all of α-santalene (1), β-santalene (2), epi-β-santalene (3) and α-exo-bergamotene (4, α-trans-bergamotene) (see FIGS. 1A and 1B). Generally, the modified santalene synthase polypeptides provided herein, including modified santalene synthase polypeptides encoded by any of the nucleic acid molecules provided herein, catalyze the production of α-santalene, β-santalene and/or α-exo-bergamotene as the major products, for example, as a combined total percentage of terpene products of >90%, and generally greater than 95%, 96%, 97%, 98%, 99% or greater.

Also provided herein are methods for producing terpenoids that are derived from the terpene product(s) produced by the above methods. For example, the terpene products can be further processed to yield the respective terpene alcohol. The further processing can be carried out by any means known to the skilled person, such as use of an appropriate cytochrome P450 enzyme, or chemical reactions such as alkaline metalation, borylation and oxidation, to yield the correct cis alcohols. For example, the methods can be used to produce santalols and bergamotol, such as (Z)-α-santalol (5), (E)-α-santalol (6), (Z)-β-santalol (7), (E)-β-santalol (8), (E)-epi-β-santalol (9), (Z)-epi-β-santalol (10), (Z)-α-exo-bergamotol (11, (Z)-α-trans-bergamotol) and/or (E)-α-exo-bergamotol (12, (E)-α-trans-bergamotol) from santalenes and bergamotene (FIGS. 1A and 1B).

The formation of terpenes and terpenol products can be analyzed by any method known to a skilled artisan, such as using enzyme assays or mass spectrometry. Also provided herein are methods for assessing the activity and/or product profile of the santalene synthase polypeptides provided herein using such assays.

1. Production of Terpene Products (e.g., Santalenes and Bergamotenes)

The modified santalene synthase polypeptides provided herein, including modified santalene synthase polypeptides encoded by the nucleic acid molecules provided herein, can be used to catalyze the formation of terpenes, such as the formation of α-santalene, β-santalene and/or bergamotene, from an acyclic pyrophosphate precursor, such as FPP. The reaction can be performed in vitro or in vivo.

For example, terpene products of santalene synthase can be produced in vitro using the modified santalene synthases provided herein. As described above in Section D, a suitable host cell containing heterologous nucleic acid encoding a modified santalene synthase polypeptide can be used for expression of the modified santalene synthase. The modified santalene synthase polypeptide can be expressed and purified from any suitable host cell, such as described in Section D. The purified synthases can then be incubated in vitro with a FPP substrate to produce terpene products, such as α-santalene, β-santalene and/or bergamotene. An organic solvent can be added to partition the terpene products into the organic phase for analysis. Production of terpene products and quantification of the amount of product are then determined using any method known to a skilled artisan or described herein, such as gas chromatography (e.g., GC-MS or GC-FID) using an internal standard or standards to quantify the terpene product(s) produced.

Alternatively, terpene products of santalene synthase can be produced in vivo in a host cell using the modified santalene synthases provided herein. The modified santalene synthases provided herein can be expressed in cells that produce or overproduce FPP, such that terpene products (e.g., α-santalene, β-santalene and/or bergamotene) are produced by the cell. The terpene products (e.g., α-santalene, β-santalene and/or bergamotene) can then be extracted from the cell culture medium with an organic solvent and subsequently isolated and purified by any known method, such as column chromatography or HPLC. The amount and purity of the recovered products can be assessed. In some examples, the terpene products are converted or processed by oxidation to their respective terpenoid either before or after purification. For example, processing of a terpene to a terpenoid can be performed in vivo in a host cell that co-expresses an appropriate cytochrome P450 enzyme.

Exemplary and non-limiting methods of producing terpene products from a modified santalene synthase are described below.

a. Exemplary Host Cells

Provided herein are host cells that contain heterologous nucleic acid encoding any of the modified santalene synthase polypeptides provided herein. Typically, the host cell produces an acyclic pyrophosphate terpene precursor. For example, the host cell produces farnesyl diphosphate (FPP). In some examples, the host cell can be a cell line that produces FPP as part of the mevalonate-dependent isoprenoid biosynthetic pathway (e.g., fungi, including yeast cells, and animal cells) or the mevalonate-independent isoprenoid biosynthetic pathway (e.g., bacteria and higher plants). In some examples, the host cell produces farnesyl diphosphate natively. In other examples, the host cell is modified to produce more farnesyl diphosphate compared to an unmodified cell. The host cells can be used to produce terpene products of the modified santalene synthase (e.g., α-santalene, β-santalene and/or bergamotene).

Exemplary host cells include bacteria, yeast, insect, plant and mammalian cells. In particular examples, the host cell is a yeast cell. For example, the yeast cell is a *Saccharomyces* genus cell, such as a *Saccharomyces cerevisiae* cell. In another example, the yeast cell is a *Pichia* genus cell, such as a *Pichia pastoris* cell. In other particular examples, the host cell is an *Escherichia coli* cell.

The host cells can be cells that have been modified to produce or to produce more FPP compared to an unmodified cell. Exemplary of such cells are modified yeast cells. Non-limiting examples of yeast cells modified to produce or overproduce FPP are described above. The use of such host cells for expression of a santalene synthase provided herein allows for increased yields of the precursor FPP and thus allows for increased yields of santalenes and bergamotenes.

For example, yeast cells that have been modified to produce less squalene synthase or less active squalene synthase (e.g., erg9 mutants; see e.g., U.S. Pat. Nos. 6,531,303 and 6,689,593) are useful in the methods provided herein. Reduced squalene synthase activity results in accumulation of FPP in the host cell at higher levels compared to wild type yeast cells, thus allowing for increased yields of santalenes and bergamotenes. Exemplary modified yeast cells include, but are not limited to, modified *Saccharomyces cerevisiae* strains YPH499 (MATa, ura3-52, lys2-801, ade2-101, trp1-Δ63, his3-Δ200, leu2-Δ1), WAT11 (MATa, ade2-1, his3-11, -15; leu2-3, -112, ura3-1, canR, cyr+; containing chromosomally integrated *Arabidopsis* NADPH-dependent P450 reductase ATR1; see Pompon et al. (1995) *Toxicol Lett* 82-83:815-822; Ro et al. (2005) *Proc Natl Acad Sci USA* 102:8060-8065); and BY4741 (MATa, his3Δ1, leu2Δ0, met15Δ0, ura3Δ0; ATCC #201388), modified *Saccharomyces cerevisiae* strains CALI5-1 (ura3, leu2, his3, trp1, Δ erg9::HIS3, HMG2cat/TRP1::rDNA, dpp1, sue), ALX7-95 (ura3, his3, trp1, Δerg9::HIS3, HMG2cat/TRP1::rDNA, dpp1 sue), ALX11-30 (ura3, trp1, erg9$^{def}$25, HMG2cat/TRP1::rDNA, dpp1, sue), which are known and described in one or more of U.S. Pat. Nos. 6,531,303, 6,689,593, 7,838,279, 7,842,497, and U.S. Pat. publication Nos. 20040249219 and 20110189717.

*Saccharomyces cerevisiae* strain CALI5-1 (ura3, leu2, his3, trp1, Δerg9::HIS3, HMG2cat/TRP1::rDNA, dpp1, sue) is a derivative of SW23B#74 (described in U.S. Pat. Nos. 6,531,303 and 6,689,593, and Takahashi et al. (2007) Biotechnol Bioeng. 97(1): 170-181), which itself is derived from wild-type strain ATCC 28383 (MATa). CALI5-1 was generated to have a decreased activity of the Dpp1 phosphatase (see e.g., U.S. Patent Publication. No. US20040249219). *Saccharomyces cerevisiae* strain CALI5-1 contains, among other mutations, an erg9 mutation (the Δerg9::HIS3 allele) as well as a mutation supporting aerobic sterol uptake enhancement (sue). It also contains approximately 8 copies of the truncated HMG2 gene. The truncated form of HMG2 is driven by the GPD promoter and is therefore no longer under tight regulation, allowing for an increase in carbon flow to FPP. It also contains a deletion in the gene encoding diacylglycerol pyrophosphate (DGPP) phosphatase enzyme (dpp1), which limits dephosphorylation of FPP.

ALX7-95 (ura3, his3, trp1, Δerg9::HIS3, HMG2cat/TRP1::rDNA, dpp1, sue) and ALX11-30.1 (ura3, trp1, erg9$^{def}$25, HMG2cat/TRP1::rDNA, dpp1, sue) are derivatives of CALI5-1. ALX7-95 was derived from CALI5-1 by correcting the Δleu2 deficiency of CALI5-1 with a functional leu gene so that leucine is not required to be supplemented to the media (see e.g., US2010/0151519). ALX11-30 is derived from intermediate cell lines derived from CALI5-1 and is described in US2010/0151519 and US2012/0246767. Briefly, ALX7-95 HPS was obtained by transforming a plasmid containing the *Hyoscyamus muticus* premnaspirodiene synthase (HPS) into ALX7-95 strain. The YEp-HPS plasmid was obtained by cloning the gene for HPS into YEp-GW-URA to give YEp-HPS-ura (YEp-HPS). Then, an error prone PCR reaction of the ERG9 gene was performed, and the resulting DNA was transformed into ALX7-95 harboring YEpHPS. Transformants were plated on YP medium lacking ergosterol and screened for premnaspirodiene production. Those that produced high levels of premnaspirodiene were saved. One strain, ALX7-168.25 [ura3, trp1, his3, erg9$^{def}$25, HMG2cat/TRP1::rDNA, dpp1, sue, YEpHPS] was transformed with a PCR fragment of the complete HIS3 gene to create a functional HIS3 gene. Transformants were isolated that were able to grow in the absence of histidine in the medium. From this transformation, ALX7-175.1 was isolated [ura3, trp1, erg9$^{def}$25, HMG2cat/TRP1::rDNA, dpp1, sue YEpHPS]. Finally, the plasmid YEp-HPS was removed by growing ALX7-175.1 several generations in YPD (10 g/L yeast extract, 20 g/L peptone, 20 g/L glucose) and plating cells on YPD plates. Colonies were identified that were unable to grow on SD medium without uracil (0.67 Bacto yeast nitrogen base without amino acids, 2% glucose, 0.14% yeast synthetic drop-out medium without uracil). This strain was designated ALX11-30.

b. Culture of Cells for Terpene Production

To produce terpene products using any of the modified santalene synthase polypeptides provided herein, a modified santalene synthase provided herein is expressed in a host cell line that produces FPP (e.g., has been modified to produce FPP), whereby upon expression of the santalene synthase, farnesyl diphosphate is converted to santalenes and bergamotene or other terpene products. The host cell can be cultured using any suitable method well known in the art. In some examples, such as for high throughput screening of cell expressing various santalene synthases, the cells expressing the santalene synthases are cultured in individual wells of a 96-well plate. In other examples, where the host cell is yeast, the cells expressing the santalene synthase polypeptide and FPP are cultured using fermentation methods such as those described below.

A variety of fermentation methodologies can be used for the production of santalenes and/or bergamotene from yeast cells expressing the modified santalene synthase polypeptides provided herein. For example, large scale production can be effected by either batch or continuous fermentation. A classical batch fermentation is a closed system where the composition of the medium is set at the beginning of the fermentation and not subject to artificial alterations during the fermentation. Thus, at the beginning of the fermentation the medium is inoculated with the desired microorganism or microorganisms and fermentation is permitted to occur without further addition of nutrients. Typically, the concentration of the carbon source in a batch fermentation is limited, and factors such as pH and oxygen concentration are controlled. In batch systems the metabolite and biomass compositions of the system change constantly up to the time the fermentation is stopped. Within batch cultures cells typically modulate through a static lag phase to a high growth log phase and finally to a stationary phase where growth rate is diminished or halted. If untreated, cells in the stationary phase will eventually die.

A variation on the standard batch system is the Fed-Batch system, which is similar to a typical batch system with the exception that nutrients are added as the fermentation progresses. Fed-Batch systems are useful when catabolite repression tends to inhibit the metabolism of the cells and where it is desirable to have limited amounts of substrate in the medium. Also, the ability to feed nutrients will often result in higher cell densities in Fed-Batch fermentation processes compared to Batch fermentation processes. Factors such as pH, dissolved oxygen, nutrient concentrations, and the partial pressure of waste gases such as CO are generally measured and controlled in Fed-Batch fermentations.

Production of the terpene products, such as α-santalene, β-santalene and/or bergamotene, also can be accomplished with continuous fermentation. Continuous fermentation is an open system where a defined fermentation medium is added continuously to a bioreactor and an equal amount of conditioned medium is removed simultaneously for processing. This system generally maintains the cultures at a constant high density where cells are primarily in their log phase of growth. Continuous fermentation allows for modulation of any number of factors that affect cell growth or end product concentration. For example, one method will maintain a limiting nutrient such as the carbon source or nitrogen level at a fixed rate and allow all other parameters to moderate. In other systems a number of factors affecting growth can be altered continuously while the cell concentration, measured by the medium turbidity, is kept constant. Continuous systems aim to maintain steady state growth conditions and thus the cell loss due to the medium removal must be balanced against the cell growth rate in the fermentation. Methods of modulating nutrients and growth factors for continuous fermentation processes as well as techniques for maximizing the rate of product formation are well known in the art.

As described below, the product of the cell culture can be used to produce the respective terpenoids, e.g., santalol and/or bergamotol. If desired, following cell culture, the cell culture medium can be harvested to obtain the produced terpene product, such as α-santalene, β-santalene and/or bergamotene, for reaction with FPP to product the terpenoid.

c. Isolation and Assays for Detection and Identification of Terpene Products (e.g., Santalenes and Bergamotene)

The terpene products (e.g., α-santalene, β-santalene and/or bergamotene) produced using the methods above with the santalene synthase polypeptides provided herein can be isolated and assessed by any method known in the art. In one example, the cell culture medium is extracted with an organic solvent to partition any terpenes or terpenoids produced into the organic layer. In another example, the terpene products are isolated by distillation and/or by removal of the santalene synthase polypeptides. Production of terpene products (e.g., α-santalene, β-santalene and/or bergamotene) can be assessed using any method known in the art, such as, for example, gas chromatography or column chromatography. For example, the organic layer can be analyzed by GC-MS. Similar procedures can be used to isolate a desired terpene product or products from other products.

For example, the quantity of terpene products (e.g., α-santalene, β-santalene and/or bergamotene) produced can be determined by any known standard chromatographic technique useful for separating and analyzing organic compounds. For example, terpene production (e.g., α-santalene, β-santalene and/or bergamotene) can be assayed by any known chromatographic technique useful for the detection and quantification of hydrocarbons, including, but not limited to, gas chromatography mass spectrometry (GC-MS), gas chromatography using a flame ionization detector (GC-FID), capillary GC-MS, high performance liquid chromatography (HPLC) and column chromatography.

Typically, these techniques are carried out in the presence of authentic and/or internal standards which are used to quantify the amount of the terpene produced. For example, terpenes, including sesquiterpenes, such as santalene and/or bergamotene, can be identified by comparison of retention times and mass spectra to those of authentic standards in gas chromatography with mass spectrometry detection. An internal standard, such as PSD or hexadecane, can be used to aid in quantitation of the samples and standardize comparison of samples. Quantification also can be achieved by gas chromatography with flame ionization detection based upon calibration curves with known amounts of authentic standards and normalization to the peak area of an internal standard. These chromatographic techniques allow for the identification of any terpene present in the organic layer, including, for example, other terpenes produced by the santalene synthases.

In some examples, kinetics of santalene and/or bergamotene production can be determined by synthase assays in which radioactive isoprenoid substrates, such as $^3$H FPP or $^{14}$C FPP, are used with varying concentrations of synthase. The products are extracted into an organic layer and radioactivity is measured using a liquid scintillation counter. Kinetic constants are determined from direct fits of the Michaelis-Menton equation to the data.

2. Production of Terpenoids (e.g., Santalols and/or Bergamotols)

The terpene products (e.g., α-santalene, β-santalene and/or bergamotene) produced by the modified santalene synthases can then be further processed, for example by oxidation, to produce the respective terpenoids (e.g., α-santalol, β-santalol and/or bergamotol). The further processing can be effected by chemical synthesis or biosynthesis. For example, oxidation achieved by hydroxylation or monooxygenation of terpene substrates can occur biosynthetically in a cell that expresses an appropriate cytochrome P450 oxidase. Cytochrome P450 oxidases involved in the oxidation of santalenes (e.g., α-, β- and/or epi-β-) and/or bergamotene are known (see e.g., Diaz-Chavez et al. (2013) PLoS One, 8:e75053). For example, host cells can be co-transformed with nucleic acid encoding any of the modified santalene synthases provided herein and with a nucleic acid encoding an appropriate cytochrome P450 oxidase. The heterologous nucleic acid can be provided separately or as a chimeric nucleic acid encoding both polypeptides. The host cell also can be engineered to express a cytochrome P450 reductase (see also, Diaz-Chavez et al.).

Production of terpenoids (e.g., α-santalol, β-santalol and/or bergamotol), including the quantification of the amount of product, can be determined using any method known to a skilled artisan, such as gas chromatography-mass spectroscopy (e.g., GC-MS), gas chromatography-flame ionization detection (GC-FID) or liquid chromatography-mass spectroscopy (LC-MS). Mass spectrometry patterns can be compared to known standards or with known terpenoids in sandalwood oil.

F. EXAMPLES

The following examples are included for illustrative purposes only and are not intended to limit the scope of the invention.

Example 1

Codon-Optimized *Santalum album* Santalene Synthase (SaSSy) and *Santalum Spicatum* Santalene Synthase (SspiSSy) and Production of Terpene Products Nucleic acid encoding the *Santalum album* santalene synthase (SaSSy) and *Santalum spicatum* santalene synthase (SspiSSy) were codon-optimized for expression in yeast.

Table 7 sets forth the nucleotide changes in the codon-optimized SaSSy (SEQ ID NO:3, encoding the sequence of amino acids set forth in SEQ ID NO:1) as compared to wild type SaSSy (SEQ ID NO:2, encoding the sequence of amino acids set forth in SEQ ID NO:1). The encoded amino acid sequence of codon-optimized SaSSy is identical to wild type SaSSy.

Table 8 sets forth the nucleotide changes in the codon-optimized SspiSSy (SEQ ID NO:44, encoding the sequence of amino acids set forth in SEQ ID NO:10) as compared to wild type SspiSSy (SEQ ID NO:11, encoding the sequence of amino acids set forth in SEQ ID NO:10). The encoded amino acid sequence of codon-optimized SspiSSy is identical to wild type SspiSSy.

TABLE 7

Synonymous changes in codon-optimized SaSSy versus wild type SaSSy

| Amino Acid | Nucleotide Change | Amino Acid | Nucleotide Change | Amino Acid | Nucleotide Change |
|---|---|---|---|---|---|
| T5T | ACC→ACT | S175S | TCA→TCT | H375H | CAT→CAC |
| A6A | GCC→GCT | G178G | GGA→GGT | E376E | GAG→GAA |
| T7T | ACC→ACT | I184I | ATC→ATT | R377R | CGA→AGA |
| A8A | GCC→GCT | L185L | CTA→TTG | G378G | GGC→GGT |
| T10T | ACA→ACT | A188A | GCC→GCT | N380N | AAT→AAC |
| P16P | CCT→CCA | A190A | GCC→GCT | S381S | AGC→TCT |
| T17T | ACT→ACC | T192T | ACC→ACT | P383P | CCT→CCA |
| H19H | CAT→CAC | C195C | TGC→TGT | T384T | ACT→ACC |
| V20V | GTG→GTT | S198S | AGT→TCC | I386I | ATC→ATT |
| N21N | AAT→AAC | A199A | GCA→GCT | K387K | AAA→AAG |
| L22L | CTC→TTG | N202N | AAT→AAC | A388A | GCG→GCT |
| T24T | ACT→ACC | I203I | ATA→ATT | V390V | GTT→GTC |
| T26T | ACG→ACC | S204S | TCC→TCT | Q392Q | CAG→CAA |
| A28A | GCC→GCT | L208L | TTA→TTG | S395S | TCA→TCT |
| S29S | TCA→TCT | V212V | GTG→GTT | Q397Q | CAG→CAA |
| E30E | GAG→GAA | H214H | CAT→CAC | A400A | GCA→GCT |
| N31N | AAT→AAC | A215A | GCA→GCT | R401R | AGA→CGT |
| R32R | CGA→AGA | P219P | CCT→CCA | G405G | GGG→GGT |
| R33R | AGG→AGA | V224V | GTC→GTT | G406G | GGA→GGT |
| G35G | GGA→GGT | P225P | CCT→CCA | H407H | CAC→CAT |
| N36N | AAT→AAC | R226R | CGA→AGA | T408T | ACG→ACT |
| Y37Y | TAT→TAC | I227I | ATC→ATT | P409P | CCT→CCA |
| K38K | AAA→AAG | A229A | GCT→GCC | S415S | AGC→TCC |
| P39P | CCC→CCA | E234E | GAG→GAA | N417N | AAT→AAC |
| S40S | AGC→TCT | A235A | GCA→GCC | G418G | GGA→GGT |
| I41I | ATT→ATC | Y2 36Y | TAT→TAC | L419L | CTT→TTG |
| N43N | AAT→AAC | E237E | GAG→GAA | S421S | TCC→TCT |
| Y44Y | TAT→TAC | E239E | GAA→GAG | I422I | ATA→ATT |
| D45D | GAT→GAC | A240A | GCG→GCT | G423G | GGA→GGT |
| F46F | TTT→TTC | N241N | AAT→AAC | L426L | CTC→TTG |
| L47L | TTA→TTG | T245T | ACA→ACC | L428L | TTA→TTG |
| S49S | TCA→TCT | L246L | CTA→TTG | I429I | ATC→ATT |
| L50L | CTT→TTG | L247L | CTC→TTG | T430T | ACG→ACA |
| A51A | GCA→GCT | K248K | AAA→AAG | G431G | GGC→GGT |
| T52T | ACT→ACC | L249L | CTC→TTG | V433V | GTG→GTT |
| N55N | AAT→AAC | K251K | AAA→AAG | A434A | GCA→GCT |
| I56I | ATT→ATA | L252L | TTA→TTG | I435I | ATC→ATT |
| V57V | GTG→GTC | D253D | GAC→GAT | E437E | GAG→GAA |
| E59E | GAG→GAA | F254F | TTT→TTC | N438N | AAC→AAT |
| R60R | AGG→AGA | N255N | AAT→AAC | E439E | GAG→GAA |
| L62L | CTA→TTG | V257V | GTG→GTT | A440A | GCT→GCC |
| L64L | CTA→TTG | S259S | TCA→TCC | A441A | GCA→GCT |
| A65A | GCT→GCC | I260I | ATT→ATC | L442L | CTG→TTG |
| E66E | GAG→GAA | H261H | CAT→CAC | K444K | AAA→AAG |
| L68L | CTG→TTG | Q262Q | CAG→CAA | V445V | GTG→GTT |
| K69K | AAG→AAA | E264E | GAG→GAA | H446H | CAC→CAT |
| G70G | GGC→GGT | G266G | GGG→GGT | P447P | CCC→CCA |
| V72V | GTG→GTC | L268L | TTA→TTG | L448L | CTT→TTG |
| F76F | TTT→TTC | A269A | GCA→GCT | P449P | CCT→CCA |
| G77G | GGG→GGT | R270R | AGG→AGA | L451L | CTT→TTG |
| A78A | GCA→GCT | V273V | GTG→GTT | L452L | CTG→TTG |
| E81E | GAG→GAA | G276G | GGC→GGT | S455S | TCC→TCA |
| P82P | CCG→CCA | L280L | TTA→TTG | L457L | CTC→TTG |
| L83L | TTA→TTG | A281A | GCC→GCT | L458L | CTT→TTG |
| A84A | GCA→GCT | F282F | TTT→TTC | S459S | AGT→TCC |
| L86L | CTG→TTG | A283A | GCC→GCT | R460R | CGC→AGA |
| E87E | GAG→GAA | R284R | AGG→AGA | L461L | CTC→TTG |
| L88L | CTT→TTG | N285N | AAT→AAC | N463N | AAT→AAC |
| V89I | GTG→GTT | N286N | AAT→AAC | I465I | ATA→ATT |

TABLE 7-continued

Synonymous changes in codon-optimized SaSSy versus wild type SaSSy

| Amino Acid | Nucleotide Change | Amino Acid | Nucleotide Change | Amino Acid | Nucleotide Change |
|---|---|---|---|---|---|
| D90D | GAT→GAC | L287L | TTA→TTG | G466G | GGA→GGT |
| V91V | GTG→GTT | L288L | CTG→TTG | T467T | ACG→ACT |
| R94R | AGG→AGA | Q289Q | CAG→CAA | P469P | CCG→CCA |
| L95L | CTT→TTG | S290S | AGC→TCC | D470D | GAT→GAC |
| G96G | GGG→GGT | Y291Y | TAT→TAC | E471E | GAG→GAA |
| L97L | CTA→TTG | S294S | AGC→TCT | A473A | GCA→GCT |
| L100L | CTA→TTG | C295C | TGC→TGT | G475G | GGC→GGT |
| F101F | TTT→TTC | A296A | GCG→GCT | N477N | AAT→AAC |
| E102E | GAG→GAA | S299S | TCC→TCT | L478L | CTG→TTG |
| T103T | ACA→ACC | P301P | CCG→CCA | S480S | TCA→TCC |
| E104E | GAG→GAA | F303F | TTC→TTT | H482H | CAT→CAC |
| K106K | AAG→AAA | K304K | AAA→AAG | G489G | GGG→GGT |
| A108A | GCG→GCC | L305L | CTT→TTG | S491S | TCC→TCT |
| L109L | CTG→TTG | A306A | GCT→GCC | E492E | GAG→GAA |
| F110F | TTT→TTC | T309T | ACT→ACC | R496R | CGT→AGA |
| S111S | AGT→TCC | I310I | ATT→ATA | E497E | GAG→GAA |
| I112I | ATT→ATC | V311 | VGTC→GTT | I499I | ATA→ATC |
| G116G | GGG→GGT | G314G | GGA→GGT | G501G | GGA→GGT |
| S117S | AGC→TCT | S315S | AGT→TCC | V502V | GTA→GTC |
| G119G | GGA→GGT | V316V | GTA→GTT | I503I | ATC→ATT |
| G123G | GGC→GGT | L317L | CTC→TTG | E504E | GAG→GAA |
| L125L | CTT→TTG | T318T | ACA→ACC | E505E | GAG→GAA |
| A127A | GCG→GCT | D321D | GAC→GAT | N506N | AAT→AAC |
| S129S | TCT→TCC | G323G | GGA→GGT | K508K | AAA→AAG |
| L130L | CTC→TTG | Y324Y | TAT→TAC | I509I | ATA→ATC |
| R131R | CGA→AGA | D325D | GAC→GAT | L510L | CTG→TTG |
| F132F | TTT→TTC | V326V | GTC→GTT | Q512Q | CAG→CAA |
| R133R | AGG→AGA | Y327Y | TAT→TAC | F515F | TTT→TTC |
| L134L | CTG→TTA | S329S | TCA→TCC | S518S | TCT→TCC |
| L135L | CTA→TTG | D331D | GAC→GAT | Q519Q | CAG→CAA |
| R136R | CGA→AGA | L333L | CTT→TTG | F520F | TTT→TTC |
| Q137Q | CAG→CAA | D334D | GAT→GAC | Q521Q | CAG→CAA |
| C138C | TGT→TGC | L335L | CTC→TTG | E522E | GAG→GAA |
| G139G | GGG→GGT | T337T | ACA→ACC | P523P | CCT→CCA |
| L140L | CTT→TTG | S338S | AGC→TCT | F524F | TTT→TTC |
| F141F | TTT→TTC | S339S | TCC→TCT | I525I | ATA→ATC |
| I142I | ATT→ATC | R342R | AGG→AGA | N528N | AAT→AAC |
| P143P | CCC→CCA | S344S | AGC→TCC | R533R | CGA→AGA |
| D145D | GAT→GAC | C345C | TGT→TGC | G534G | GGG→GGT |
| V146V | GTG→GTT | V346V | GTG→GTT | S535S | TCT→TCC |
| F147F | TTT→TTC | D349D | GAC→GAT | Y539Y | TAT→TAC |
| K148K | AAA→AAG | T354T | ACG→ACC | F541F | TTT→TTC |
| T149T | ACG→ACC | L355L | TTA→TTG | G542G | GGG→GGT |
| G155G | GGG→GGT | K356K | AAA→AAG | G544G | GGC→GGT |
| F157F | TTT→TTC | L357L | TTA→TTG | G546G | GGG→GGT |
| K160K | AAA→AAG | I358I | ATT→ATC | V547V | GTG→GTT |
| L161L | CTT→TTG | F359F | TTT→TTC | T548T | ACG→ACT |
| C162C | TGT→TGC | S361S | TCT→TCC | S550S | AGC→TCC |
| D163D | GAC→GAT | T366T | ACC→ACT | T552T | ACA→ACC |
| V165V | GTA→GTT | N367N | AAT→AAC | D562D | GAC→GAT |
| K166K | AAA→AAG | E368E | GAG→GAA | P563P | CCT→CCA |
| G167G | GGG→GGT | G370G | GGC→GGT | P565P | CCT→CCA |
| L168L | CTG→TTG | L371L | CTT→TTG | L566L | CTC→TTG |
| L169L | CTG→TTG | R372R | CGA→AGA | G567G | GGC→GGT |
| S170S | AGC→TCC | V373V | GTC→GTT | E568E | GAG→GAA |
| L171L | TTA→TTG | Q374Q | CAG→CAA | E569E | GAG→GAA |

TABLE 8

Synonymous changes in codon-optimized SspiSSy versus wild type SspiSSy

| Amino Acid | Nucleotide Change | Amino Acid | Nucleotide Change | Amino Acid | Nucleotide Change |
|---|---|---|---|---|---|
| D2D | GAT→GAC | G178G | GGG→GGT | A388A | GCA→GCC |
| S4S | TCC→TCT | I184I | ATC→ATA | Q392Q | CAG→CAA |
| T5T | ACC→ACT | L185L | CTA→TTG | K394K | AAA→AAG |
| A6A | GCC→GCT | A188A | GCC→GCT | A395A | GCA→GCC |
| A8A | GCC→GCT | K189K | AAG→AAA | Y396Y | TAC→TAT |
| T9T | ACG→ACT | A190A | GCC→GCT | Q397Q | CAG→CAA |
| T10T | ACA→ACT | T193T | ACC→ACT | E399E | GAG→GAA |

TABLE 8-continued

Synonymous changes in codon-optimized SspiSSy versus wild type SspiSSy

| Amino Acid | Nucleotide Change | Amino Acid | Nucleotide Change | Amino Acid | Nucleotide Change |
|---|---|---|---|---|---|
| P12P | CCA→CCT | A199A | GCA→GCC | A400A | GCA→GCC |
| T17T | ACT→ACC | N202N | AAT→AAC | Y403Y | TAC→TAT |
| H19H | CAT→CAC | I203I | ATA→ATT | H404H | CAT→CAC |
| V20V | GTG→GTC | L208L | CTA→TTG | G405G | GGG→GGT |
| N21N | AAT→AAC | A209A | GCC→GCT | G406G | GGA→GGT |
| L22L | CTT→TTG | V212V | GTG→GTT | H407H | CAC→CAT |
| K23K | AAA→AAG | H214H | CAT→CAC | T408T | ACG→ACT |
| I24I | ATT→ATC | A215A | GCA→GCT | P409P | CCT→CCA |
| N26N | AAT→AAC | L216L | CTG→TTG | E412E | GAG→GAA |
| S29S | TCC→TCT | P219P | CCT→CCA | S415S | AGC→TCA |
| E30E | GAG→GAA | L220L | CTG→TTG | N417N | AAT→AAC |
| S31S | AGT→TCC | H221H | CAC→CAT | G418G | GGA→GGT |
| R32R | CGA→AGA | V224V | GTC→GTT | L419L | CTT→TTG |
| R33R | AGG→AGA | P225P | CCT→CCA | I422I | ATA→ATC |
| G35G | GGC→GGT | R226R | CGA→AGA | G423G | GGA→GGT |
| Y37Y | TAT→TAC | I227I | ATC→ATT | L426L | CTC→TTG |
| K38K | AAA→AAG | E228E | GAG→GAA | I429I | ATC→ATT |
| P39P | CCC→CCA | E234E | GAG→GAA | T430T | ACC→ACT |
| S40S | AGT→TCC | A235A | GCA→GCC | G431G | GGC→GGT |
| N43N | AAT→AAC | Y236Y | TAT→TAC | I433I | ATC→ATT |
| Y44Y | TAT→TAC | E237E | GAG→GAA | A434A | GCA→GCT |
| F46F | TTT→TTC | E240E | GAG→GAA | E437E | GAG→GAA |
| L47L | CTG→TTG | T245T | ACA→ACT | E439E | GAG→GAA |
| S49S | TCA→TCC | L246L | CTA→TTG | A441A | GCA→GCT |
| L50L | CTT→TTG | L247L | CTC→TTG | L442L | CTG→TTG |
| A51A | GCA→GCC | L249L | CTT→TTG | D443D | GAT→GAC |
| I52I | ATC→ATT | A250A | GCA→GCC | V445V | GTG→GTT |
| N55N | AAT→AAC | K251K | AAA→AAG | H446H | CAC→CAT |
| I56I | ATT→ATC | L252L | TTA→TTG | P447P | CCC→CCA |
| V57V | GTG→GTT | D253D | GAC→GAT | L448L | CTT→TTG |
| E59E | GAG→GAA | F254F | TTT→TTC | P449P | CCT→CCA |
| H61H | CAT→CAC | V257V | GTG→GTC | L451L | CTT→TTG |
| L62L | CTA→TTG | S259S | TCA→TCC | L452L | CTG→TTG |
| L64L | CTA→TTG | I260I | ATT→ATC | S455S | TCC→TCA |
| A65A | GCT→GCC | H261H | CAT→CAC | S456S | TCC→TCT |
| E66E | GAG→GAA | Q262Q | CAG→CAA | L457L | CTC→TTG |
| K67K | AAG→AAA | E264E | GAG→GAA | L458L | CTT→TTG |
| L68L | CTG→TTG | G266G | GGG→GGT | S459S | AGT→TCA |
| G70G | GGC→GGT | L268L | TTA→TTG | R460R | CGC→AGA |
| V72V | GTG→GTC | R270R | AGG→AGA | L461L | CTC→TTG |
| G77G | GGG→GGT | V273V | GTG→GTT | N463N | AAT→AAC |
| A78A | GCA→GCT | G276G | GGC→GGT | D464D | GAC→GAT |
| E81E | GAG→GAA | L280L | TTA→TTG | G466G | GGA→GGT |
| P82P | CCG→CCA | A281A | GCC→GCT | T467T | ACG→ACT |
| L83L | TTA→TTG | A283A | GCT→GCC | P469P | CCG→CCA |
| A84A | GCA→GCT | R284R | AGG→AGA | E471E | GAG→GAA |
| K85K | AAG→AAA | N285N | AAT→AAC | A473A | GCA→GCT |
| L86L | CTG→TTG | N286N | AAT→AAC | D476D | GAC→GAT |
| E87E | GAG→GAA | L287L | TTA→TTG | N477N | AAT→AAC |
| L88L | CTT→TTG | L288L | CTG→TTG | L478L | CTG→TTG |
| V89V | GTG→GTT | S290S | AGC→TCT | K479K | AAG→AAA |
| V91V | GTG→GTC | Y291Y | TAT→TAC | S480S | TCA→TCT |
| R94R | AGG→AGA | S294S | AGC→TCT | C483C | TGT→TGC |
| L95L | CTT→TTG | A296A | GCG→GCT | G489G | GGG→GGT |
| G96G | GGG→GGT | S299S | TCC→TCT | E492E | GAG→GAA |
| L97L | CTA→TTG | D300D | GAC→GAT | R496R | CGT→AGA |
| H99H | CAC→CAT | F303F | TTC→TTT | E497E | GAG→GAA |
| F101F | TTT→TTC | K304K | AAA→AAG | H498H | CAC→CAT |
| E102E | GAG→GAA | L305L | CTT→TTG | I499I | ATA→ATT |
| T103T | ACA→ACC | A306A | GCT→GCC | K500K | AAA→AAG |
| E104E | GAG→GAA | T309T | ACT→ACC | G501G | GGA→GGT |
| K106K | AAG→AAA | G314G | GGA→GGT | I502I | ATA→ATC |
| L109L | CTA→TTG | S315S | AGT→TCT | E504E | GAG→GAA |
| F110F | TTT→TTC | V316V | GTA→GTT | E505E | GAG→GAA |
| S111S | AGT→TCC | L317L | CTC→TTG | N506N | AAT→AAC |
| G116G | GGG→GGT | T318T | ACA→ACC | K508K | AAA→AAG |
| S117S | AGC→TCT | V320V | GTG→GTT | I509I | ATA→ATT |
| G119G | GGA→GGT | D321D | GAC→GAT | L510L | CTG→TTG |
| G123G | GGC→GGT | A323A | GCA→GCT | Q512Q | CAG→CAA |
| L125L | CTT→TTG | Y327Y | TAT→TAC | F515F | TTT→TTC |
| A127A | GCA→GCT | S329S | TCA→TCC | D516D | GAT→GAC |
| L130L | CTT→TTG | L333L | CTT→TTG | Q519Q | CAG→CAA |
| R131R | CGA→AGA | H335H | CAC→CAT | F520F | TTT→TTC |
| F132F | TTT→TTC | T337T | ACA→ACC | Q521Q | CAG→CAA |

TABLE 8-continued

Synonymous changes in codon-optimized SspiSSy versus wild type SspiSSy

| Amino Acid | Nucleotide Change | Amino Acid | Nucleotide Change | Amino Acid | Nucleotide Change |
|---|---|---|---|---|---|
| R133R | AGG→AGA | S339S | TCC→TCT | E522E | GAG→GAA |
| L134L | CTA→TTA | V340V | GTT→GTC | P523P | CCT→CCA |
| L135L | CTA→TTG | R342R | AGG→AGA | F524F | TTT→TTC |
| R136R | CGA→AGA | S344S | AGC→TCT | I525I | ATA→ATT |
| Q137Q | CAG→CAA | V346V | GTA→GTC | F527F | TTC→TTT |
| C138C | TGT→TGC | D349D | GAC→GAT | N528N | AAT→AAC |
| G139G | GGG→GGT | L351L | CTG→TTG | S531S | TCT→TCC |
| L140L | CTT→TTG | T354T | ACG→ACT | R533R | CGA→AGA |
| F141F | TTT→TTC | L355L | TTA→TTG | G534G | GGG→GGT |
| P143P | CCC→CCA | K356K | AAA→AAG | S535S | TCT→TCC |
| Q144Q | CAG→CAA | I358I | ATT→ATC | F538F | TTC→TTT |
| V146V | GTG→GTT | F359F | TTT→TTC | Y539Y | TAT→TAC |
| F147F | TTT→TTC | S361S | TCT→TCC | G542G | GGG→GGT |
| K148K | AAA→AAG | N367N | AAT→AAC | G544G | GGC→GGT |
| T149T | ACG→ACC | E368E | GAG→GAA | F545F | TTT→TTC |
| Q151Q | CAG→CAA | G370G | GGC→GGT | G546G | GGG→GGT |
| S152S | AGC→TCT | L371L | CTT→TTG | V547V | GTG→GTT |
| K153K | AAA→AAG | R372R | CGA→AGA | T548T | ACA→ACT |
| T154T | ACT→ACC | V373V | GTC→GTT | S550S | AGC→TCT |
| F157F | TTT→TTC | Q374Q | CAG→CAA | K553K | AAG→AAA |
| K160K | AAA→AAG | H375H | CAT→CAC | D555D | GAT→GAC |
| L161L | CTG→TTG | E376E | GAG→GAA | S558S | TCT→TCC |
| C162C | TGT→TGC | R377R | CGA→AGA | I561I | ATC→ATT |
| D163D | GAC→GAT | G378G | GGC→GGT | P563P | CCT→CCA |
| I165I | ATA→ATC | Y379Y | TAC→TAT | P565P | CCT→CCA |
| K166K | AAA→AAG | G381G | GGC→GGT | L566L | CTC→TTG |
| G167G | GGG→GGT | I382I | ATC→ATT | G567G | GGC→GGT |
| S170S | AGC→TCC | P383P | CCT→CCA | E568E | GAG→GAA |
| Y172Y | TAT→TAC | T384T | ACT→ACC | E569E | GAG→GAA |
| F176F | TTC→TTT | I386I | ATC→ATT | | |
| L177L | CTG→TTG | K387K | AAA→AAG | | |

Example 2

Production of Terpene Products by Codon-Optimized Versus Wild-Type SaSSy

To assess production of terpene products, the codon-optimized santalene synthase genes described in Example 1 were cloned into the pAlx48-16.2 plasmid (SEQ ID NO:284). pAlx48-16.2 carries an E. coli origin of replication for use as a shuttle vector. It also contains an ampicillin resistance marker for use in E. coli and a URA3 marker for selection in yeast. It also contains an inactive version (C-terminus only) of codon-optimized SaSSy (SEQ ID NO:289) that itself does not result in production of any terpene product, and thereby assures there are no "false positives" during the screening process of the cloned gene.

The cloned plasmid was then transformed into ALX7-95 S. cerevisiae (ura3, his3, trp1, Δerg9::HIS3, HMG2cat/TRP1::rDNA, dpp1, sue; described in US2010/0151519) using a standard lithium acetate yeast transformation. Transformants were selected on SDE-ura medium (0.67% Bacto yeast nitrogen base without amino acids, 2% glucose, 0.14% yeast synthetic drop-out medium supplement without uracil, and 40 mg/L ergosterol). Colonies were picked, cultured and screened for terpene production as described below.

A. Terpene Production in Shake Flask Assay

To assess production of santalene and other terpene products, a seed culture of 10 mL was inoculated in a 250 mL flask using SDE medium. The culture was grown for 24 hr before 2.5 mL was used to inoculate 50 mL fermentation medium (2% ammonium sulfate, 2% potassium phosphate, 0.1% NaCl, 0.6% $MgSO_4 \cdot 7H_2O$, 0.4% yeast extract, 1 mL mineral solution [$FeSO_4 \cdot 7H_2O$ 0.028%, $ZnSO_4 \cdot 7H_2O$ 0.029%, $CuSO_4 \cdot 5H_2O$ 0.008%, $Na_2MoO_4 \cdot 2H_2O$ 0.024%, $CoCl_2 \cdot 6H_2O$ 0.024%, $MnSO_4$—$H_2O$ 0.017%, HCl 1 mL], 0.5 ml 50% glucose, 1.5 ml vitamin solution [biotin 0.001%, Ca-pantothenate 0.012%, inositol 0.06%, pyridoxine-HCl 0.012%, thiamine-HCl 0.012%], 0.5 ml 10% $CaCl_2$) containing 1 mL vegetable oil in a 250 mL baffled flask. The cultures were grown at 28° C. After 16 hr of incubation, the cultures were fed 1.5 ml 50% glucose and 0.278 ml 12.5% yeast extract. 24 hr after the initial feed, the cultures were fed 2.5 ml 50% glucose and 0.470 ml 12.5% yeast extract. 48 hr after the initial feed, the cultures were fed 3.6 ml 50% glucose and 0.667 ml 12.5% yeast extract. The pH of the cultures was adjusted to 4.5 every 24 hrs with the addition of 30% NaOH. After approximately 88 hours of incubation, 0.1 ml of IGEPAL CA-630 was added and the culture was incubated with shaking to fully homogenize the vegetable oil. After 30 minutes, a 2 mL culture sample was taken. The sample was extracted with 2 mL acetone/PSD solution (20 mg/L premnaspirodiene (PSD)) and then extracted with 4 mL hexane/hexadecane solution (10 mg/L hexadecane). An aliquot from extracted samples were analyzed by gas chromatography (GC-FID). Using the internal standards, the total production of products and product profile were assessed by calculating from the peak area.

B. Results

1. Codon-Optimized SaSSy Versus Wild-Type SaSSy

The total production of terpene products produced by codon-optimized SaSSy (SEQ ID NO:3) versus wild type SaSSy (SEQ ID NO:2) was compared. Total product production from cultures expressing the codon-optimized SaSSy (SEQ ID NO:3) was approximately 15% higher than that from cultures expressing the wild type SaSSy enzyme (SEQ ID NO:2) (based on a comparison of ~12 samples of each). For example, in 12 samples expressing the codon-optimized SaSSy there was, on average, 15.9% higher total production than in 12 samples expressing wild type SaSSy.

Wild type SaSSy and codon-optimized SaSSy produced three major products (α-santalene, β-santalene, and α-exo-bergamotene). The profile of the three major products had a small but reproducible shift; α-santalene and β-santalene (combined) made up 70.62% of product in the 12 codon-optimized samples, while these two santalenes made up 73.63% of product in the wild type samples. Codon-optimized SaSSy produced 45.7%±1.03 α-santalene, 26.12%±0.64 β-santalene and 30.40%±1.43 α-exo-bergamotene (average of 27 experiments).

The codon-optimized SaSSy also produced three minor products (epi-β-santalene, (E)-β-farnesene, and (Z)-β-farnesene). Production of (Z)-β-farnesene or (E)-β-farnesene were not calculated, as their peak areas was very small. The peak for epi-β-santalene overlapped with the peak for (E)-β-farnesene and separation was not always possible. Over the course of 27 experiments in which these two minor peaks could be separated, the epi-β-santalene peak area accounted for 3.5% of the four measured peak areas. In experiments in which the two peaks were non-separable, the combined peak accounted for 5% of the four measured peak areas. The three minor products are not produced in commercially desirable quantities.

2. Codon-Optimized SaSSy Versus Wild-Type and Codon-Optimized *Santalum Spicatum* Santalene Synthase (SspiSSy)

The total production of terpene products produced by codon-optimized SaSSy (SEQ ID NO:3) also was compared to wild type *Santalum spicatum* Santalene Synthase (SspiSSy; SEQ ID NO:11) and codon-optimized SspiSSy (SEQ ID NO:44). The SaSSy and SspiSSy codon-optimized genes were observed to have no significant difference in total production relative to each other. The two codon-optimized genes, however, produced approximately 35% more total product than wild type SspiSSy in a comparison of 2 samples of codon-optimized SaSSy, 24 samples of codon-optimized SspiSSy, and 24 samples of wild type SspiSSy.

The results also showed that the product profile of the wild type SspiSSy gene was different from the codon-optimized SspiSSy, even though the amino acid sequences were identical. Table 9 below sets forth the product profiles for wild type SspiSSy, codon-optimized SspiSSy and codon-optimized SaSSy. For example, over the 24 samples of codon-optimized SspiSSy and 24 samples of wild type SspiSSy, the wild type gene produced approximately 49% α-santalene and β-santalene (combined), while the codon-optimized gene produced only approximately 44% α-santalene and β-santalene (combined).

TABLE 9

Product distribution of three major products

| Santalene Synthase | α-santalene | β-santalene | α-exo-bergamotene |
|---|---|---|---|
| codon-optimized SaSSy | 40.18% | 21.71% | 38.11% |
| codon-optimized SspiSSy | 32.05% (±0.84%) | 12.86% (±0.34%) | 55.09% (±0.62%) |
| wild-type SspiSSy | 35.47 (±0.23%) | 14.29% (±0.2%) | 50.24% (±0.32%) |

Example 3

Santalene Synthase Variants and Generation of Mutant Plasmids

Santalene synthase (SaSSy) variants were generated by standard molecular biology techniques from the codon-optimized santalene synthase described in Example 1 and set forth in SEQ ID NO:3. One or more of the strategies described in this Example below was used to generate SaSSy variants.

To incorporate mutations, mutagenic plasmids were prepared by direct recombination in yeast of a generated mutant PCR product containing the mutations with a cut plasmid backbone, either the pAlx48-16.2 plasmid described above (SEQ ID NO:284; containing a truncated version (C-terminus only) of codon-optimized SaSSy) or the pAlx72-5.4 plasmid (SEQ ID NO:290; containing a truncated version (C-terminus only) of SaSSy-6). Like pAlx48-16.2, pAlx72-5.4 is a shuttle vector that contains an *E. coli* origin of replication, an ampicillin resistance marker for use in *E. coli* and a URA3 marker for selection in yeast. Compared to pAlx48-16.2, yeast recombination using pAlx72-5.4 avoids incidental loss of mutations near the 3'end of the gene. The yeast strains ALX7-95 (ura3, his3, trp1, Δerg9::HIS3, HMG2cat/TRP1::rDNA, dpp1, sue; described in US2010/0151519) or ALX11-30 (ura3, trp1, erg9def25, HMG2cat/TRP1::rDNA, dpp1, sue; described in US2010/0151519 and US2012/0246767) were employed.

Briefly, PCR outer primers were designed to have a minimum of 30 nucleotides of overlap with the plasmid backbone, either pAlx48-16.2 or pAlx72-5.4. Mutagenic primers were also designed to have a minimum of 30 nucleotides of overlap with each other. Single stage PCR was conducted using a santalene synthase DNA template (e.g., codon-optimized SaSSy set forth in SEQ ID NO:3) with an outer primer and a mutagenic primer. PCR products were gel purified using standard techniques. Before recombination in yeast, the desired plasmid backbone, either pAlx48-16.2 or pAlx72-5.4, was cut with restriction enzymes KpNI and XbaI, and the desired fragment was gel purified. Then, 200-250 ng of the PCR product and 200-250 ng of the cut plasmid backbone were combined and used in standard lithium acetate yeast transformations, and were plated onto selective media. The yeast homologous recombination DNA repair pathway gene products recombine the overlapping PCR fragments and cut plasmid backbone to form a completely new plasmid within the yeast cell. All variant plasmids were generated and expressed using ALX7-95 cells with the exception of variants SaSSy-62, SaSSy-63, SaSSy-66, SaSSy-64, SaSSy-67, Sassy-135, SaSSy-136 and SaSSy-137 (see Table 11 and the Examples), which were grown using ALX11-30 cells. Resulting colonies were tested for terpene production using procedures as described in Example 4 below.

1. Domain Swaps

Briefly, a number of variants were generated containing domain or loop swaps with other terpene synthases (designated domain swaps). Domain swaps included regions of various terpene synthases, including *Hyoscyamus muticus* vetispiradiene synthase (HVS; set forth in SEQ ID NO:197), (+)-bornyl diphosphate synthase (set forth in SEQ ID NO:198), citrus valencene synthase variant V19 described in U.S. Patent Publication No. 2012-0246767 (set forth in SEQ ID NO:199), *Vitis vinifera* valencene synthase (set forth in SEQ ID NO:200) and bergamotene synthase (set forth in SEQ ID NO:201). Table 10 sets forth the amino acids that were targeted for replacement in SaSSy with amino acid residues from the corresponding domain from another synthase.

Upon sequencing of generated variant synthases (see Table 11 in Example 4), some of the swaps were identified to contain mutations in the swapped region, which were likely introduced during PCR or synthesis of the gene. For example, SaSSy-25 (SEQ ID NO:69 and 153) was generated to contain a domain swap of amino acid residues 138-166 with the corresponding residues 109-136 from bergamotene synthase (SEQ ID NO:210). The generated SaSSy-25 contained two mutations compared to the corresponding domain region of bergamotene synthase set forth in SEQ ID NO:210, such that the actual domain swap that was replaced in SaSSy-25 is set forth as amino acids HGH-HVPQEVFCSFMDDVGNFRAWLCEDVR (SEQ ID NO:215).

2. V346A

When testing multiple colonies from the swap of the Citrus valencene synthase V19 sequence (SEQ ID NO:199) into the loop between predicted helices 4 and 5 (amino acids 116-124 of SEQ ID NO:1), a variant (SaSSy-1; SEQ ID NO:131) was identified containing a spontaneous mutation designated V346A in addition to a planned domain swap. As shown in Example 4, the SaSSy-1 variant resulted in significantly higher terpene production than other isolates. Therefore, the mutation V346A was incorporated as an amino acid replacement in generated variants.

3. Modified N-Terminus

Variants also were generated by replacement of the N-terminus with an equivalent portion of another terpene synthase (designated modified N-terminus). For example, SaSSy amino acids 1-31 with reference to SEQ ID NO:1 were exchanged with the region up to the RR/RP motif of another terpene synthase (e.g., HVS set forth in SEQ ID

TABLE 10

Domain Swaps

| Amino acids in SaSSy (SEQ ID NO: 1) | Other Terpene Synthase | Corresponding Amino acids in Other Synthase | Amino Acid Sequence of Corresponding Domain in Other Synthase | |
|---|---|---|---|---|
| | | | Amino Acid Residues | SEQ ID NO |
| 1-31 | Vetispiradiene synthase | 1-16 | MAPAIVMSNYEEEEIV | 202 |
| 73-79 | (+)-Bornyl diphosphate synthase | 94-100 | RILLKEK | 203 |
| 78-81 | (+)-Bornyl diphosphate synthase | 99-102 | EKME | 204 |
| 97-100 | Citrus valencene synthase V19 | 74-77 | VAYH | 205 |
| 103-115 | Citrus valencene synthase V19 | 80-92 | KEIEDAIQQLCPI | 206 |
| 116-124 | Citrus valencene synthase V19 | 93-100 | HIDSDKAD | 207 |
| 116-124 | *Vitis vinifera* valencene synthase | 104-113 | FHDCNDMDGD | 208 |
| 116-124 | (+)-Bornyl diphosphate synthase | 137-149 | HKCFHNNEVEKMD | 209 |
| 138-166 | bergamotene synthase | 109-136 | HGHHVPQEAFCSFMDDVRNFRAWLCEDVR | 210 |
| 138-166 | bergamotene synthase with two mutations (underlined) compared to wild type bergamotene synthase | 109-136** | HGHHVPQEVFCSFMDDVGNFRAWLCEDVR | 215 |
| 138-168 | Citrus valencene synthase V19 | 114-144 | QGIKISCDVFEQFKDDEGRFKSSLINDVQGM | 211 |
| 138-168 | Citrus valencene synthase V19 with two mutations (underlined) compared to wild type V19 | 114-144** | QGIKISCDVFEQFKDDEDRFKSSLINDIQGM | 212 |
| 198-207 | *Vitis vinifera* valencene synthase | 187-195 | AMVESLGYH | 213 |
| 330-345 | bergamotene synthase | 302-320 | LEELQLFTQTIERWDINSL | 214 |

NO:197 and encoding the sequence of amino acids set forth in SEQ ID NO:276; CVS variant V19 set forth in SEQ ID NO:199 and encoding the sequence of amino acids set forth in SEQ ID NO:269; TEAS set forth in SEQ ID NO:216 and encoding the sequence of amino acids set forth in SEQ ID NO:273, germacrene A set forth in SEQ ID NO:217 and encoding the sequence of amino acids set forth in SEQ ID NO:274; *Vitis vinifera* valencene synthase (VvCVS) set forth in SEQ ID NO:200 and encoding the sequence of amino acids set forth in SEQ ID NO:270; amorpha-4,11-diene synthase (ADS) set forth in SEQ ID NO:218 and encoding the sequence of amino acids set forth in SEQ ID NO:275; and premnaspirodiene synthase (HPS) from *Hyoscyamus muticus* set forth in SEQ ID NO:221 and encoding the sequence of amino acids set forth in SEQ ID NO: 272 (see e.g., Table 5).

When the generated variants were tested for terpene production using procedures similar to described in Example 4, the results showed that variants containing a modified N-terminus (also designated "RR to RP" swap mutants) resulted in decreased production. Thus, this result demonstrates that replacing the N-terminus up to the RR/RP motif of another terpene, shows that the RR to RP is important for terpene production.

4. N-terminal Deletion

Among the generated variants, a variant was identified containing a M1V mutation (SaSSy-44; SEQ ID NO:88 and 168) that had improved overall production, with alpha-exo-bergamotene as the major product (see Example 4). Given that yeast is not believed to use alternate translational initiation codons as in some bacteria, it is likely that the M1V amino acid replacement resulted in a truncation to the next methionine codon, corresponding to amino acid residue 34, which happens to be in the correct reading frame for the remainder of the enzyme. Thus, a N-terminal deletion mutant (SaSSy-112; SEQ ID NO:263 and 267) was generated that lacked N-terminal amino acid residues 1-33 similar to what is believed to occur with the SaSSy-44 gene product when expressed in yeast. Production data confirmed that the mutant designated SaSSy-112 produced predominantly α-exo-bergamotene in amounts similar to those found in the M1V mutant (SaSSy-44).

5. SaSSy/SpisSSy Hybrids

Variants also were generated that were hybrids containing amino acids from *Santalum spicatum* synthase (SspiSSy) incorporated in the *Santalum album* synthase (SaSSy) (designated SaSSy/SspiSSy hybrids). The santalene synthase enzyme from *Santalum album* (SaSSy) and the santalene synthase enzyme from *Santalum spicatum* (SSpiSSy) differ at 31 amino acid positions (see FIG. 3A).

Using SaSSy as the starting point, amino acid residues from SspiSSy that differed with SaSSy were introduced into SaSSy to generate a series of variant hybrid SaSSys genes. Nineteen (19) mutations from SspiSSy were identified that, when introduced into SaSSy, resulted in a variant that retained full function, including both total titer, and product profile (see variant designated SaSSy-2 in Table 11; see also Example 4). This SaSSy/SspiSSy hybrid was used as a backbone to generate further domain swap variants, including regions of various terpene synthases described above.

Additional variants also were generated also containing one or more of the other 12 amino acid differences in addition to the 19 mutations indicated above. For example, variants were generated that incorporated four changes from the N-terminus of SspiSSy (M9T, T24I, T26N and A28S) (see, e.g., variants SaSSy-5, SaSSy-43 and SaSSy-76 in Table 11; see also Example 4). Variants generated containing one or more of these 12 amino acid differences either decreased total production, or changed product profile, or both, at least within the groupings that were tested.

6. Randomization of Residues

Additional variants also were generated in which the position corresponding to L130, K213, P225, N255, S329-D331, L333-T337, S344-E347, C345, C393-K394 or A473 were randomized.

For example, a neutral, random mutation at A473 was identified in an earlier isolate, which indicated that the location could be modified without loss of function. Therefore, the position was chosen to randomly mutate to identify whether improvements in production or product profile could be obtained (see, e.g., variants SaSSy-28 and SaSSy-32 to SaSSy-36 in Table 11).

Additional variants were generated in which the position corresponding to C393 was randomized in combination with K394. There was no improvement in enzyme total production in the mutants that were isolated, and several of the isolates tested had a decrease in the proportion of alpha- and beta-santalene production.

7. Beta-Farnesene Synthase Equivalents

Variants were generated in which equivalent positions corresponding to mutations of a (E)-beta-farnesene synthase from *A. annua* (SEQ ID NO:305) that exhibit improved enzymatic activity were randomized in SaSSy (U.S. Pat. No. 8,236,512). For example, beta-farnesene synthase equivalent positions that were randomized include amino acid residue 35, 38, 50, 55, 56, 57, 61, 64, 70, 72, 86, 112, 117, 125, 128, 140, 170, 177, 183, 192, 206, 246, 275, 282, 300, 313, 342, 351, 353, 363, 365, 379, 392, 417, 427, 428, 436, 438, 452, 459, 479, 480, 483, 487, 497, 518, 523 or 548. Other variants were identified that containg an amino acid replacement at a beta-farnesene synthase equivalent position that increases terpene production (see Example 4 and Table 11, e.g., SaSSy-82, SaSSy-83, SaSSy-84, SaSSy-85, SaSSy-90, SaSSy-92, SaSSy-91, SaSSy-94, SaSSy-95, SaSSy-101, SaSSy-102, SaSSy-104, SaSSy-111, SaSSy-113, SaSSy-114, SaSSy-115, SaSSy-116, SaSSy-117, SaSSy-118, SaSSy-121, SaSSy-122, SaSSy-123, SaSSy-124, SaSSy-135, SaSSy-136, SaSSy-137). For example, the randomization of F282 resulted in identification of F282W variants, which catalyze significantly reduced percentages of α-exo-bergamotene. Variants containing the replacement corresponding to F282W exhibit this altered profile.

8. Exposed to Solvent

Variants were also generated by mutation of solvent exposed residues to identify whether improvements in production or product profile could be obtained by such modifications. For example, the residues corresponding to 156, V57 and L64 were randomly mutated. For example, variants SaSSy-120 and SaSSy-121 were identified with mutations at position 156 and variants SaSSy-127 and SaSSy-128 identified with mutations at position 64.

The residue corresponding to C162 (which is partially exposed to solvent) was mutated to isoleucine (C162I) as part of a loop swap (see Table 10 above; swap of amino acids 138-166 of SaSSy with amino acids 114-144 of citrus valencene synthase V19), and the point mutant C162V (SaSSy-38), which was generated by a PCR enzyme error, was identified. The C162V and loop swap changes were neutral with respect to total production and product profile.

The residue corresponding to C195 (which is slightly exposed to solvent) was mutated to tyrosine (C195Y) as part of a loop swap.

The residue corresponding to C345 (which is significantly exposed to solvent) was randomly mutated. Initial data shows that amino acid replacements at position C345 improve either total production or product profile, particularly the amino acid replacement C345T (see SaSSy-63 to SaSSy-67 in Table 11 and Example 4 below).

Example 4

Expression, Production and Activity of Santalene Synthase Variants

Variants expressed as described in Example 3 were assayed for santalene synthase activity to produce terpene products (e.g., α-santalene, β-santalene, α-exo-bergamotene and epi-β-santalene). Colonies were selected, cultured and screened for terpene production as described below using a high throughput microculture assay. Transformants that produced at or above control levels (codon-optimized SaSSy), or had a unique product profile, were additionally tested in shake flasks. Terpene production (santalene synthase activity) was determined by gas chromatography (GC-FID) using PSD or hexadecane as internal standards. The total production of products and product profile were assessed. Terpene production was compared to the codon-optimized SaSSy enzyme (SEQ ID NO:3 and encoding SaSSy set forth in SEQ ID NO:1), which was used as a control. The screening results are set forth below.

A. Screening Assays

1. Microculture Assay

To screen transformants for production of santalene and other terpene products, a high-throughput screening procedure using microvial cultures was employed. Transformant yeast colonies were inoculated into individual wells of 96-well deep well microtiter plates filled with 200 μL of SDE-THUL (0.67% Bacto yeast nitrogen base without amino acids, 2% glucose, 0.14% yeast synthetic drop-out medium without uracil, leucine, histidine, tryptophan, 40 mg/L ergosterol). The plate was grown for two to three days at 28° C. After growth to saturation, 10 or 20 μL from each well was used to inoculate the wells of a 96-well deep well plate containing 300 μL of medium suitable for growth and santalene production. The deep well plate was sealed with breathable sealing film (Excel Scientific RSMB-2-S) and then incubated with shaking for 3 days. The products were extracted first by introducing 250 μL of acetone and vortexing, followed by addition of 500 μL of n-hexane and vortexing. After extraction, the deep well plate was re-sealed using heat sealing film (Axygen Scientific HS-400).

After phase separation, the deep well plate was placed on the sample tray of a gas chromatography autosampler, which removed one microliter of the organic phase for analysis of sesquiterpenes. The acetone and hexane used for extraction were each spiked with internal standards (PSD in acetone, hexadecane in hexanes) to aid in quantitation of the samples. The extracted samples were analyzed by gas chromatography. Using the internal standards, the total production of products and product profile were assessed by calculating from the peak area. Each variant was screened twice in microculture.

2. Shake Flask Assay

Mutants that produced >100% terpenes (α-santalene, α-exo-bergamotene, epi-β-santalene and β-santalene) relative to codon-optimized SaSSy or had a unique product profile were also screened in shake flasks.

For the shake flask assay, a seed culture of 10 mL was inoculated in a 250 mL flask using SDE medium. The culture was grown for 24 hr before 2.5 mL was used to inoculate 50 mL fermentation medium (2% ammonium sulfate, 2% potassium phosphate, 0.1% NaCl, 0.6% $MgSO_4.7H_2O$, 0.4% yeast extract, 1 mL mineral solution [$FeSO_4.7H_2O$ 0.028%, $ZnSO_4.7H_2O$ 0.029%, $CuSO_4.5H_2O$ 0.008%, $Na_2MoO_4.2H_2O$ 0.024%, $CoCl_2.6H_2O$ 0.024%, $MnSO_4.H_2O$ 0.017%, HCl 1 mL], 0.5 ml 50% glucose, 1.5 ml vitamin solution [biotin 0.001%, Ca-pantothenate 0.012%, inositol 0.06%, pyridoxine-HCl 0.012%, thiamine-HCl 0.012%], 0.5 ml 10% $CaCl_2$) with 1 mL vegetable oil in a 250 baffled flask. The cultures were grown at 28° C. After 16 hr of incubation, the cultures were fed 1.5 ml 50% glucose and 0.278 ml 12.5% yeast extract. 24 hr after the initial feed, the cultures were fed 2.5 ml 50% glucose and 0.470 ml 12.5% yeast extract. 48 hr after the initial feed, the cultures were fed 3.6 ml 50% glucose and 0.667 ml 12.5% yeast extract. The pH of the cultures was adjusted to 4.5 every 24 hrs with the addition of 30% NaOH.

After approximately 88 hours of incubation, 0.1 ml of IGEPAL CA-630 was added and the culture was incubated with shaking to fully homogenize the vegetable oil. After 30 minutes, a 2 mL culture sample was taken. The sample was extracted with 2 mL acetone/PSD solution (20 mg/L PSD) and then extracted with 4 mL hexane/hexadecane solution (10 mg/L hexadecane). An aliquot was analyzed by GC and the amount of santalene and other terpene products was determined. Alternatively, hexadecane (10 mg/L) was added to the vegetable oil to a concentration of 2 g/L, and the hexadecane-spiked vegetable oil was added to each shake flask, and the sample was extracted with 2 mL acetone, followed by extraction with 4 mL hexanes.

B. Results

Transformants that at least retained total terpene production of the codon-optimized variant, had a modified product profile, or retained total terpene production of the codon-optimized variant and had a modified product profile were selected.

1. Total Production

Table 11 also sets forth the total production for each of the SaSSy variants as assessed in the shake flasks assay. All variants were grown using ALX7-95 cells with the exception of variants SaSSy-62, SaSSy-63, SaSSy-66, SaSSy-64 and SaSSy-67, which were grown using ALX11-30 cells. A percentage greater than 100% indicates an increase in production as compared to codon-optimized SaSSy and a percentage less than 100% indicates a decrease in production as compared to codon-optimized SaSSy. A difference of greater than 5% in total production is considered to be significant.

The results in Table 11 show that the majority of the variants had a total terpene production that was at least equivalent (or improved) versus codon-optimized SaSSy (encoded by SEQ ID NO:3), which itself has approximately 15% higher total terpene production than the wild type SaSSy enzyme (encoded by SEQ ID NO:2) (see Example 2 above). For example, the total terpene production of the SaSSy/SspiSSy hybrid (SaSSy-2 variant) was 99.9% (average of 2 flasks) of that of codon-optimized SaSSy total production. Hence, these variants exhibit improved terpene production compared to wild type SaSSy.

Some of the variants containing the amino acid replacement V346A (e.g., SaSSy-1, SaSSy-6, SaSSy-50 and others; see Table 11) have repeatedly shown total terpene production increases of 25-50% compared to the codon-optimized SaSSy. The V346A mutation itself was responsible for much of the increase in production, since the total production was increased from 15-40% when this mutation was introduced compared to parental strains not including the mutation. For example, the total terpene production of SaSSy-1 was approximately 9% higher than that of SaSSy-37, and the total terpene production for SaSSy-6 was approximately 18% higher than that of SaSSy-3. SaSSy-6 contains three amino acid changes (V346A, K350R and N353D) in comparison to SaSSy-3, but the other two changes had no significant effect on production.

The results also show that variants containing amino acid replacements corresponding to the residue N183 (e.g., SaSSy-46, 135, 136, and 137) also catalyze an increase of total terpene production by 25-73% compared to the codon-optimized SaSSy. For example, the total terpene production of SaSSy-46, which contains an additional N183E mutation compared to SaSSy-6, was approximately 54% higher than that of SaSSy-6.

The results also show that certain "silent" changes can impact enzymatic production. For example, SaSSy-8 exhibits a greater increased total terpene production compared to SaSSy-9 due to a silent codon change encoding amino acid residue G123. SaSSy-11, which differs from SaSSy-12 by two silent codon changes encoding amino acids 270 and 536, also exhibits a greater increased total terpene production compared to SaSSy-12. SaSSy-39 contains a silent codon change compared to SaSSy-3 encoding amino acid L411L, SaSSy-4 has a silent codon change compared to SaSSy-3 encoding P225, and SaSSy-62 has four silent codon changes encoding amino acid residues V340V, S344S, C345C or V346V. SaSSy-66 exhibits a less increased terpene production compared to SaSSy-63, and differs from SaSSy-63 via a silent codon change encoding amino acid 476.

TABLE 11

Identified Santalene Synthase Variants

| Variant | Description | Amino Acid Changes | Nucleotide Changes | SEQ ID NO aa | SEQ ID NO nuc | Total Terpene Production (% codon-optimized SaSSy) |
|---|---|---|---|---|---|---|
| codon-optimized SaSSy | codon-optimized | | | 1 | 3 | 100 |
| | | Random Mutagenesis | | | | |
| SaSSy-17 | 1 aa change | F101L | TTT→CTC | 145 | 61 | n/d shake flask |
| | | Modified N-terminus | | | | |
| SaSSy-10 | 32 aa changes Contains one domain Swap: 1-31 replaced with 1-16 of HVS and one additional amino acid change | M1→—— D2→—— S3→—— S4→—— T5→—— A6→—— T7→—— A8→—— M9→—— T10→—— A11→—— P12→—— F13→—— I14→M1 D15→A2 P16→—— T17→—— D18→P3 H19→A4 V20→I5 N21→V6 L22→M7 K23→S8 T24→N9 B25→Y10 T26→E11 B27→E12 A28→E13 S29→E14 E30→I15 N31→V16 S329→F314 | ATG→—— GAT→—— TCT→—— TCC→—— ACC→—— GCC→—— ACC→—— GCC→—— ATG→—— ACA→—— GCT→—— CCA→—— TTC→—— ATT→ATG GAT→GCC CCT→—— ACT→—— GAT→CCA CAT→GCT GTG→ATA AAT→GTG CTC→ATG AAA→AGT ACT→AAC GAT→TAC ACG→GAA GAT→GAG GCC→GAG TCA→GAG GAG→ATT AAT→GTT TCA→TTC | 139 | 54 | 74 |
| | | Domain Swaps | | | | |
| SaSSy-8 | 7 aa changes | K73R | AAG→AGG | 138 | 52 | 148.17 |
| SaSSy-9 | Contains one domain swap: AA 73-79 replaced with 94-100 of BDS | F74I M75L F76L G77K | TTT→ATA ATG→CTG TTT→CTA GGG→AAG | 138 | 53 | 124.35 |

TABLE 11-continued

Identified Santalene Synthase Variants

| Variant | Description | Amino Acid Changes | Nucleotide Changes | SEQ ID NO aa | SEQ ID NO nuc | Total Terpene Production (% codon-optimized SaSSy) |
|---|---|---|---|---|---|---|
| SaSSy-7 | 3 aa changes Contains one domain swap: AA 78-81 replaced with 99-102 of BDS; and one additional amino acid change | A78E P79K A78E P79K K85Q | GCA→GAA CCA→AAA GCA→GAG CCA→AAA AAG→CAG | 137 | 51 | 129.96 |
| SaSSy-11 SaSSy-12 | 4 aa changes Contains one domain swap: 97-100 replaced with 74-77 of Citrus valencene synthase V19 | L97V N98A H99Y L100H | CTA→GTT AAC→GCT CAC→TAC CTA→CAT | 140 140 | 55 56 | 124.49 107.95 |
| SaSSy-22 | 10 aa changes Contains one domain swap: 103-115 replaced with 80-92 of Citrus valencene synthase V19 | T103K K106E E107D L109I F110Q S111Q I112L Y113C K114P D115I | ACA→AAA AAG→GAA GAA→GAT CTG→ATT TTT→CAA AGT→CAA ATT→TTG TAC→TGT AAG→CCA GAT→ATT | 150 | 66 | 58.52 |
| SaSSy-37 | 9 amino acid changes Contains one domain swap; 116-124 replaced with 93-100 of Citrus valencene synthase V19 | G116H S117I N118D G119S W120D W121——— F122→K121 G123→A122 H124→D123 | GGG→CAT AGC→ATT AAT→GAT GGA→TCT TGG→GAT TGG→——— TTT→AAA GGC→GCT CAC→GAT | 288 | 287 | 130.32 |
| SaSSy-1 | 11 amino acid changes Identical to SaSSy-37, except includes V346A and F385L | G116H S117I N118D G119S W120D W121→——— F122→K121 G123→A122 H124→D123 V346→A345 F385→L384 | GGG→CAT AGC→ATT AAT→GAT GGA→TCT TGG→GAT TGG→——— TTT→AAA GGC→GCT CAC→GAT GTG→GCT TTT→CTT | 131 | 45 | 139.16 |
| SaSSy-13 | 10 aa changes Contains one domain swap: 116-124 replaced with 104-113 of VvCVS; and one additional amino acid change | K73E G116F S117H N118D ——→C119 G119→N120 W120→D121 W121→M122 F122→D123 H124→D125 | AAG→GAG GGG→TTT AGC→CAT AAT→GAC ——→TGC GGA→AAT TGG→GAT TGG→ATG TTT→GAT CAC→GAT | 141 | 57 | 133.21 |
| SaSSy-14 | 13 aa changes Contains one domain swap: 116-124 replaced with 137-149 of BDS; and one additional amino acid change | M9V G116H S117K ——→C118 ——→F119 ——→H120 ——→N121 G119→E123 W120→V124 W121→E125 F122→K126 G123→M127 H124→D128 | ATG→GTG GGG→CAC AGC→AAA ——→TGC ——→TTT ——→CAC ——→AAT GGA→GAA TGG→GTA TGG→GAG TTT→AAA GGC→ATG CAC→GAT | 142 | 58 | 118.29 |
| SaSSy-25 | 18 aa changes Contains one domain | C138H L140H | TGT→CAT CTT→CAT | 153 | 69 | 88.79 |

TABLE 11-continued

Identified Santalene Synthase Variants

| Variant | Description | Amino Acid Changes | Nucleotide Changes | SEQ ID NO aa | SEQ ID NO nuc | Total Terpene Production (% codon-optimized SaSSy) |
|---|---|---|---|---|---|---|
| | swap: 138-166 replaced with 109-136 of bergamotene synthase | F141H<br>I142V<br>D145E<br>K148C<br>T149S<br>Q151M<br>N152D<br>K153D<br>T154V<br>E156N<br>D158R<br>M159A<br>K160W<br>D163E<br>N164D<br>K166R | TTT→CAT<br>ATT→GTT<br>GAT→GAG<br>AAA→TGC<br>ACG→AGT<br>CAA→ATG<br>AAC→GAC<br>AAG→GAT<br>ACT→GTA<br>GAA→AAT<br>GAT→AGG<br>ATG→GCG<br>AAA→TGG<br>GAC→GAA<br>AAC→GAC<br>AAA→AGA | | | |
| SaSSy-26 | 20 aa changes<br>Contains one domain swap:<br>138-168 replaced with 114-144 of Citrus valencene synthase V19 | C138Q<br>L140I<br>F141K<br>P143S<br>Q144C<br>K148E<br>T149Q<br>Q151K<br>N152D<br>K153D<br>T154E<br>E156R<br>D158K<br>M159S<br>K160S<br>C162I<br>D163N<br>N164D<br>K166Q<br>L168M | TGT→CAA<br>CTT→ATT<br>TTT→AAG<br>CCC→TCT<br>CAA→TGT<br>AAA→GAA<br>ACG→CAA<br>CAA→AAG<br>AAC→GAT<br>AAG→GAT<br>ACT→GAA<br>GAA→AGA<br>GAT→AAA<br>ATG→AGT<br>AAA→TCT<br>TGT→ATT<br>GAC→AAT<br>AAC→GAT<br>AAA→CAA<br>CTG→ATG | 154 | 70 | 105.78 |
| SaSSy-16 | 11 aa changes<br>Contains one domain swap:<br>198-207 replaced with 187-195 of VvCVS; and additional amino acid changes | S198A<br>A199M<br>W200V<br>N202S<br>I203L<br>S204G<br>E205Y<br>K206→——<br>W207→H206<br>K350→R349<br>N353→D352 | AGT→GCC<br>GCA→ATG<br>TGG→GTA<br>AAT→AGT<br>ATA→TTA<br>TCC→GGA<br>GAA→TAT<br>AAG→——<br>TGG→CAT<br>AAG→AGG<br>AAC→GAC | 144 | 60 | n/d no shake flask |
| SaSSy-15 | 13 aa changes<br>Contains one domain swap:<br>330-348 replaced with 302-320 of bergamotene synthase; and one additional amino acid change | I330L<br>D331E<br>D334Q<br>Y336F<br>S338Q<br>S339T<br>V340I<br>S344D<br>C345I<br>V346N<br>E347S<br>I348L<br>N367S | ATC→TTG<br>GAC→GAA<br>GAT→CAA<br>TAC→TTC<br>AGC→CAA<br>TCC→ACA<br>GTT→ATC<br>AGC→GAT<br>TGT→ATT<br>GTG→AAT<br>GAA→TCT<br>ATT→CTG<br>AAT→AGC | 143 | 59 | n/d no shake flask |

*Santalum album* santalene synthase/*Santalum spicatum* santalene synthase (SaSSy/SspiSSy) hybrids

| Variant | Description | Amino Acid Changes | Nucleotide Changes | SEQ ID NO aa | SEQ ID NO nuc | Total Terpene Production (% codon-optimized SaSSy) |
|---|---|---|---|---|---|---|
| SaSSy-2 | A hybrid of SaSSy and SspiSSy.<br>Contains 19 aa changes | N152S<br>G155D<br>V165I<br>Y176F<br>T192A<br>C195Y<br>S198N<br>E205Q | AAC→TCT<br>GGG→GAT<br>GTA→ATC<br>TAC→TTT<br>ACC→GCC<br>TGC→TAC<br>AGT→AAT<br>GAA→CAA | 132 | 46 | 99.93 |

TABLE 11-continued

Identified Santalene Synthase Variants

| Variant | Description | Amino Acid Changes | Nucleotide Changes | SEQ ID NO aa | SEQ ID NO nuc | Total Terpene Production (% codon-optimized SaSSy) |
|---|---|---|---|---|---|---|
| | | A240E<br>G323A<br>I330M<br>L335H<br>S338Y<br>S381G<br>S395A<br>F403Y<br>V433I<br>I465M<br>V502I | GCG→GAA<br>GGA→GCT<br>ATC→ATG<br>CTC→CAT<br>AGC→TAC<br>AGC→GGT<br>TCA→GCC<br>TTC→TAT<br>GTG→ATT<br>ATA→ATG<br>GTA→ATC | | | |
| SaSSy-28 | 20 aa changes<br>Same aa changes as SaSSy-2<br>one additional amino acid change | SaSSy-2 mutations + A473P | GCA→CCA | 156 | 72 | n/d no shake flask |
| SaSSy-32 | 20 aa changes<br>Same aa changes as SaSSy-2<br>one additional amino acid change;<br>Same aa sequence as SaSSy-28 | SaSSy-2 mutations + A473P | GCA→CCG | 156 | 76 | n/d no shake flask |
| SaSSy-33 | 20 aa changes<br>Same aa changes as SaSSy-2<br>one additional amino acid change | SaSSy-2 mutations + A473E | GCA→GAG | 160 | 77 | n/d no shake flask |
| SaSSy-34 | 20 aa changes<br>Same aa changes as SaSSy-2<br>one additional amino acid change | SaSSy-2 mutations + A473L | GCA→CTC | 161 | 78 | n/d no shake flask |
| SaSSy-35 | 20 aa changes<br>Same aa changes as SaSSy-2<br>one additional amino acid change | SaSSy-2 mutations + A473V | GCA→GTT | 162 | 79 | n/d no shake flask |
| SaSSy-36 | 21 aa changes<br>Same aa changes as SaSSy-2<br>two additional amino acid changes | SaSSy-2 mutations + N364D A473V | AAC→GAC<br>GCA→GTA | 163 | 80 | n/d no shake flask |
| SaSSy-29 | 20 aa changes<br>Same aa changes as SaSSy-2<br>one additional amino acid change | SaSSy-2 mutations + S329L | TCA→CTG | 157 | 73 | n/d no shake flask |
| SaSSy-31 | 20 aa changes<br>Same aa changes as SaSSy-2<br>one additional amino acid change | SaSSy-2 mutations + F385L | TTT→CTT | 159 | 75 | n/d no shake flask |
| SaSSy-30 | 21 aa changes<br>Same aa changes as SaSSy-2<br>two additional amino acid changes | SaSSy-2 mutations + N255S F385L | AAT→AGC<br>TTT→CTT | 158 | 74 | n/d no shake flask |
| SaSSy-27 | 2 aa changes | M9T<br>Q262R | ATG→ACT<br>CAG→CGA | 155 | 71 | n/d no shake flask |
| SaSSy/SspiSSy Hybrid Replacements, modified N-terminus and domain swaps | | | | | | |
| SaSSy-3 | 91 aa changes<br>Contains multiple domain swaps:<br>AA 1-31 replaced with 1-16 of HVS<br>AA 73-79 replaced with 94-100 of BDS<br>AA 116-124 replaced with | M1→——<br>D2→——<br>S3→——<br>S4→——<br>T5→——<br>A6→——<br>T7→——<br>A8→—— | ATG→——<br>GAT→——<br>TCT→——<br>TCC→——<br>ACC→——<br>GCC→——<br>ACC→——<br>GCC→—— | 133 | 47 | 101.23 |

TABLE 11-continued

Identified Santalene Synthase Variants

| Variant | Description | Amino Acid Changes | Nucleotide Changes | SEQ ID NO aa | SEQ ID NO nuc | Total Terpene Production (% codon-optimized SaSSy) |
|---|---|---|---|---|---|---|
| | 93-100 of Citrus valencene synthase V19 AA 138-168 replaced with 114-144 of Citrus valencene synthase V19 (with variations) AA 198-207 replaced with 187-195 of VvCVS; and additional amino acid changes | M9→—— T10→—— A11→—— P12→—— F13→—— I14→M1 D15→A2 P16→—— T17→—— D18→P3 | ATG→—— ACA→—— GCT→—— CCA→—— TTC→—— ATT→ATG GAT→GCT CCT→—— ACT→—— GAT→CCA | | | |
| SaSSy-39 | 91 aa changes Same aa changes as SaSSy-3 | H19→A4 V20→I5 N21→V6 | CAT→GCT GTG→ATC AAT→GTT | 133 | 83 | 120.80 |
| SaSSy-40 | 91 aa changes Same aa changes as SaSSy-3 | L22→M7 K23→S8 T24→N9 | CTC→ATG AAA→TCT ACT→AAC | 133 | 84 | 104.11 |
| SaSSy-62 | 91 aa changes Same aa changes as SaSSy-3 | D25→Y10 T26→E11 D27→E12 A28→E13 S29→E14 E30→I15 N31→V16 K73→R58 F74→I59 M75→L60 F76→L61 G77→K62 A78→E63 P79→K64 K85→Q70 F101→L86 G116→H101 S117→I102 N118→D103 G119→S104 W120→D105 W121→—— F122→K106 G123→A107 H124→D108 C138→Q122 L140→I124 F141→K125 P143→S127 Q144→C128 K148→E132 T149→Q133 Q151→K135 N152→D136 K153→D137 T154→E138 G155→D139 E156→R140 D158→K142 M159→S143 K160→S144 C162→I146 D163→N147 N164→D148 V165→I149 K166→Q150 L168→M152 Y176→F160 T192→A176 C195→Y179 S198→A182 A199→M183 W200→V184 N202→S186 | GAT→TAC ACG→GAA GAT→GAA GCC→GAA TCA→GAA GAG→ATC AAT→GTT AAG→AGA TTT→ATC ATG→TTG TTT→TTG GGG→AAA GCA→GAA CCA→AAG AAG→CAA TTT→TTG GGG→CAT AGC→ATC AAT→GAT GGA→TCT TGG→GAT TGG→—— TTT→AAG GGC→GCT CAC→GAC TGT→CAA CTT→ATC TTT→AAG CCC→TCC CAA→TGC AAA→GAA ACG→CAA CAA→AAG AAC→GAT AAG→GAC ACT→GAA GGG→GAT GAA→AGA GAT→AAG ATG→TCC AAA→TCC TGT→ATT GAC→AAC AAC→GAC GTA→ATC AAA→CAA CTG→ATG TAC→TTT ACC→GCC TGC→TAC AGT→GCT GCA→ATG TGG→GTT AAT→TCT | 133 | 106 | 140.32 |

TABLE 11-continued

Identified Santalene Synthase Variants

| Variant | Description | Amino Acid Changes | Nucleotide Changes | SEQ ID NO aa | SEQ ID NO nuc | Total Terpene Production (% codon-optimized SaSSy) |
|---|---|---|---|---|---|---|
| | | I203→L187<br>S204→G188<br>E205→——<br>K206→Y189<br>W207→H190<br>A240→E223<br>G323→A306<br>S329→H312<br>I330→M313<br>V433→I416<br>H446→R429<br>I465→M448<br>V502→I485 | ATA→TTG<br>TCC→GGT<br>GAA→——<br>AAG→TAC<br>TGG→CAT<br>GCG→GAA<br>GGA→GCT<br>TCA→CAT<br>ATC→ATG<br>GTG→ATT<br>CAC→AGA<br>ATA→ATG<br>GTA→ATC | | | |
| SaSSy-38 | 91 aa changes Identical to SaSSy-3 except contains C162→V146 instead of C162→I146 | SaSSy-3 mutations, but with C162→V146 | SaSSy-3 mutations, but with TGT→GTT | 165 | 82 | 107.40 |
| SaSSy-63 | 92 aa changes Identical to SaSSy-3 except also contains C345→T328 | SaSSy-3 mutations + C345→T328 | SaSSy-3 mutations + TGT→ACG | 185 | 107 | 182.21 |
| SaSSy-66 | 92 aa changes Identical to SaSSy-3 except also contains C345→T328 | SaSSy-3 mutations + C345→T328 | SaSSy-3 mutations + TGT→ACC | 185 | 110 | 125.65 |
| SaSSy-64 | 92 aa changes Identical to SaSSy-3 except also contains C345→L328 | SaSSy-3 mutations + C345→L328 | SaSSy-3 mutations + TGT→TTG | 186 | 108 | 188.67 |
| SaSSy-67 | 92 aa changes Identical to SaSSy-3 except also contains C345→P328 | SaSSy-3 mutations + C345→P328 | SaSSy-3 mutations + TGT→CCT | 188 | 111 | 127.27 |
| SaSSy-65 | 93 aa changes Identical to SaSSy-3 except also contains C345→T328 and S381→P364 | SaSSy-3 mutations + C345→T328 S381→P364 | SaSSy-3 mutations + TGT→ACT AGC→CCT | 187 | 109 | n/d in ALX7-95 strain |
| SaSSy-4 | 97 aa changes Identical to SaSSy-3 except contains S329→T312 instead of S329→H312, and also contains L335→H318, S338→Y321, N367→S350, S381→G364, F385→L368, S395→A378 and F403→Y386 | SaSSy-3 mutations, but S329→T312 + L335→H318 S338→Y321 N367→S350 S381→G364 F385→L368 S395→A378 F403→Y386 | SaSSy-3 mutations, but TCA→ACT + CTC→CAT AGC→TAC AAT→TCC AGC→GGT TTT→TTG TCA→GCC TTC→TAT | 134 | 48 | 73.67 |
| SaSSy-6 | 94 aa changes Identical to SaSSy-3, except also contains V346→A329, K350→R333 and N353→D336 | M1→——<br>D2→——<br>S3→——<br>S4→——<br>T5→——<br>A6→—— | ATG→——<br>GAT→——<br>TCT→——<br>TCC→——<br>ACC→——<br>GCC→—— | 136 | 50 | 119.87 |
| SaSSy-41 | 94 aa changes Same aa changes as SaSSy-6 | T7→——<br>A8→——<br>M9→—— | ACC→——<br>GCC→——<br>ATG→—— | 136 | 85 | 112.04 |
| SaSSy-52 | 94 aa changes Same aa changes as SaSSy-6 | T10→——<br>A11→——<br>P12→—— | ACA→——<br>GCT→——<br>CCA→—— | 136 | 96 | 137.13 |
| SaSSy-56 | 94 aa changes Same aa changes as SaSSy-6 | F13→——<br>I14→M1<br>D15→A2 | TTC→——<br>ATT→ATG<br>GAT→GCT | 136 | 100 | 111.20 |
| SaSSy-61 | 94 aa changes Same aa changes as SaSSy-6 | P16→——<br>T17→——<br>D18→P3 | CCT→——<br>ACT→——<br>GAT→CCA | 136 | 105 | 117.27 |

TABLE 11-continued

Identified Santalene Synthase Variants

| Variant | Description | Amino Acid Changes | Nucleotide Changes | SEQ ID NO aa | SEQ ID NO nuc | Total Terpene Production (% codon-optimized SaSSy) |
|---|---|---|---|---|---|---|
| SaSSy-68 | 94 aa changes Same aa changes as SaSSy-6 | H19→A4 V20→I5 N21→V6 | CAT→GCT GTG→ATC AAT→GTT | 136 | 112 | 123.05 |
| SaSSy-69 | 94 aa changes Same aa changes as SaSSy-6 | L22→M7 K23→S TABLE 11-continued Identified Santalene Synthase Variants

| Variant | Description | Amino Acid Changes | Nucleotide Changes | SEQ ID NO aa | SEQ ID NO nuc | Total Terpene Production (% codon-optimized SaSSy) |
|---|---|---|---|---|---|---|
| | | K350→R333<br>N353→D336<br>V433→I416<br>H446→R429<br>I465→M448<br>V502→I485 | AAG→AGG<br>AAC→GAC<br>GTG→ATT<br>CAC→AGA<br>ATA→ATG<br>GTA→ATC | | | |
| SaSSy-96 | 95 aa changes Identical to SaSSy-6 except also contains F385→L368 | SaSSy-6 mutations + F385→L368 | SaSSy-6 mutations + TTT→CTT | 250 | 228 | 124.48 |
| SaSSy-42 | 96 aa changes Identical to SaSSy-6 except also contains S381→P364 and F385→L368 | SaSSy-6 mutations + S381→P364 F385→L368 | SaSSy-6 mutations + AGC→CCT TTT→CTT | 166 | 86 | 121.64 |
| SaSSy-45 | 95 aa changes Identical to SaSSy-6 except also contains K213→R196 | SaSSy-6 mutations + K213→R196 | SaSSy-6 mutations + AAG→AGG | 169 | 89 | 108.36 |
| SaSSy-46 | 95 aa changes Identical to SaSSy-6 except also contains N183→E167 | SaSSy-6 mutations + N183→E167 | SaSSy-6 mutations + AAC→GAA | 170 | 90 | 173.75 |
| SaSSy-47 | 95 aa changes Identical to SaSSy-6 except also contains F363→Y346 | SaSSy-6 mutations + F363→Y346 | SaSSy-6 mutations + TTC→TAT | 171 | 91 | 150.39 |
| SaSSy-48 | 94 aa changes Identical to SaSSy-6 except contains A28→G13 instead of A28→E13 | SaSSy-6 mutations, but with A28→G13 | SaSSy-6 mutations, but with GCC→GGA | 172 | 92 | 122.58 |
| SaSSy-50 | 95 aa changes Identical to SaSSy-6 except also contains R342→Q325 | SaSSy-6 mutations + R342→Q325 | SaSSy-6 mutations + AGG→CAG | 174 | 94 | 139.52 |
| SaSSy-51 | 95 aa changes Identical to SaSSy-6 except also contains A436→C419 | SaSSy-6 mutations + A436→C419 | SaSSy-6 mutations + GCT→TGT | 175 | 95 | 118.19 |
| SaSSy-57 | 96 aa changes Identical to SaSSy-6 except also contains I313→L296 and H404→Y387 | SaSSy-6 mutations + I313→L296 H404→Y387 | SaSSy-6 mutations + ATC→CTG CAC→TAC | 181 | 101 | 83.96 |
| SaSSy-58 | 95 aa changes Identical to SaSSy-6 except also contains R342→H325 | SaSSy-6 mutations + R342→H325 | SaSSy-6 mutations + AGG→CAC | 182 | 102 | 113.78 |
| SaSSy-59 | 95 aa changes Identical to SaSSy-6 except also contains R342→T325 | SaSSy-6 mutations + R342→T325 | SaSSy-6 mutations + AGG→ACT | 183 | 103 | 111.84 |
| SaSSy-60 | 95 aa changes Identical to SaSSy-6 except also contains G70→T55 | SaSSy-6 mutations + G70→T55 | SaSSy-6 mutations + GGC→ACT | 184 | 104 | 112.11 |
| SaSSy-72 | 95 aa changes Identical to SaSSy-6 except also contains I112→N97 | SaSSy-6 mutations + I112→N97 | SaSSy-6 mutations + ATT→AAC | 189 | 116 | 107.44 |
| SaSSy-74 | 95 aa changes Identical to SaSSy-6 except also contains Y379→I362 | SaSSy-6 mutations + Y379→I362 | SaSSy-6 mutations + TAC→ATC | 190 | 118 | 146.33 |
| SaSSy-77 | 94 aa changes Identical to SaSSy-6 except contains N31→A16 instead of N31→V16 | SaSSy-6 mutations, but with N31→A16 | SaSSy-6 mutations, but with AAT→GCT | 192 | 121 | 125.43 |

TABLE 11-continued

Identified Santalene Synthase Variants

| Variant | Description | Amino Acid Changes | Nucleotide Changes | SEQ ID NO aa | SEQ ID NO nuc | Total Terpene Production (% codon-optimized SaSSy) |
|---|---|---|---|---|---|---|
| SaSSy-78 | 93 aa changes Identical to SaSSy-6 except does not contain T192→A176 | SaSSy-6 mutations, but with T192→T176 | SaSSy-6 mutations, but with ACC→ACC | 193 | 122 | 125.12 |
| SaSSy-80 | 93 aa changes Identical to SaSSy-6 except does not contain T192→A176 | SaSSy-6 mutations, but with T192→T176 | SaSSy-6 mutations, but with ACC→ACA | 193 | 124 | 134.64 |
| SaSSy-81 | 93 aa changes Identical to SaSSy-6 except does not contain T192→A176 | SaSSy-6 mutations, but with T192→T176 | SaSSy-6 mutations, but with ACC→ACG | 193 | 125 | 130.32 |
| SaSSy-83 | 93 aa changes Identical to SaSSy-6 except does not contain G155→D139 | SaSSy-6 mutations, but with G155→G139 | SaSSy-6 mutations, but with GGG→GGT | 194 | 127 | 156.67 |
| SaSSy-116 | 95 aa changes Identical to SaSSy-6 except contains F74→V59 instead of F74→I59 + also contains F110→L95 | SaSSy-6, but with F74→V59 and F110→L95 | SaSSy-6 mutations + TTT→GTC TTT→CTC | 164 | 93 | 166.54 |
| SaSSy-117 | 95 aa changes Identical to SaSSy-6 except also contains G405→S388 | SaSSy-6 mutations + G405→S388 | GGG→AGT | 196 | 99 | 190.42 |
| SaSSy-118 | 96 aa changes Identical to SaSSy-6 except also contains L268→W251 and A269→P252 | SaSSy-6 mutations + L268→W251 and A269→P252 | TTA→TGG GCA→CCA | 233 | 130 | 127.78 |

SaSSy/SspiSSy Hybrid replacement(s), beta-farnesene synthase equivalent replacement(s), modified N-terminus, domain swaps

| Variant | Description | Amino Acid Changes | Nucleotide Changes | SEQ ID NO aa | SEQ ID NO nuc | Total Terpene Production (% codon-optimized SaSSy) |
|---|---|---|---|---|---|---|
| SaSSy-104 | 93 aa changes Identical to SaSSy-6 except does not contain S117→I102; and contains A28→G13 instead of A28→E13 | A28→G13 S117→S102 | GCC→GGA AGC→AGT | 255 | 236 | 126.04 |
| SaSSy-53 | 94 aa changes Identical to SaSSy-6 except contains K206→S189 instead of K206→Y189 | SaSSy-6 mutations, but with K206→S189 | SaSSy-6 mutations, but with AAG→TCC | 177 | 97 | 155.90 |
| SaSSy-97 | 94 aa changes same amino acid changes as SaSSy-53 | | | | | n/a |
| SaSSy-84 | 94 aa changes Identical to SaSSy-6 except contains K206→S189 instead of K206→Y189 | SaSSy-6 mutations, but with K206→S189 | SaSSy-6 mutations, but with AAG→TCA | 177 | 128 | 126.43 |
| SaSSy-91 | 94 aa changes Identical to SaSSy-6 except contains K206→S189 instead of K206→Y189 | SaSSy-6 mutations, but with K206→S189 | SaSSy-6 mutations, but with AAG→AGC | 177 | 223 | 147.54 |
| SaSSy-54 | 94 aa changes Identical to SaSSy-6 except contains K206→G189 instead of K206→Y189 | SaSSy-6 mutations, but with K206→G189 | SaSSy-6 mutations, but with AAG→GGT | 178 | 98 | 144.78 |
| SaSSy-89 | | | | | | n/a |
| SaSSy-82 | 94 aa changes Identical to SaSSy-6 except contains K206→G189 instead of K206→Y189 | SaSSy-6 mutations, but with K206→G189 | SaSSy-6 mutations, but with AAG→GGA | 178 | 126 | 150.13 |
| SaSSy-85 | 94 aa changes Identical to SaSSy-6 except contains | SaSSy-6 mutations, but with | SaSSy-6 mutations, but with | 195 | 129 | 132.14 |

TABLE 11-continued

Identified Santalene Synthase Variants

| Variant | Description | Amino Acid Changes | Nucleotide Changes | SEQ ID NO aa | SEQ ID NO nuc | Total Terpene Production (% codon-optimized SaSSy) |
|---|---|---|---|---|---|---|
| | K206→Q189 instead of K206→Y189 | K206→Q189 | AAG→CAG | | | |
| SaSSy-92 | 95 aa changes Identical to SaSSy-6 except contains K206→T189 instead of K206→Y189 and also contains K213→R196 | SaSSy-6 mutations, but with K206→T189 K213→R196 | SaSSy-6 mutations, but with AAG→ACG AAG→AGG | 246 | 224 | 143.87 |
| SaSSy-55 | 95 aa changes | SaSSy-6 mutations, but with | SaSSy-6 mutations, but with | 179 | 304 | 110.67 |
| SaSSy-101 | Identical to SaSSy-6 except contains K206→T189 instead of K206→Y189 and also contains F282→W265 | K206→T189 F282→W265 | AAG→ACC TTT→TGG | 179 | 304 | 108.00 |
| SaSSy-119 | 95 aa changes Identical to SaSSy-6 except contains N31→A16 instead of N31→V16 and K206→T189 instead of K206→Y189, and also contains F282→W265 | SaSSy-6 mutations + N31→A16 K206→T189 F282→W265 | AAT->GCT AAG→ACC TTT→TGG | 247 | 225 | 110.53 |
| SaSSy-102 | 95 aa changes Identical to SaSSy-6 except also contains F282→W265 | SaSSy-6 mutations + F282→W265 | SaSSy-6 mutations + TTT→TGG | 180 | 234 | 73.66 |
| SaSSy-94 | 94 aa changes Identical to SaSSy-6 except also contains R342→S325 | SaSSy-6 mutations + R342→S325 | SaSSy-6 mutations + AGG→AGT | 248 | 226 | 131.85 |
| SaSSy-111 | 95 aa changes Identical to SaSSy-6 except also contains I112→Q97 | SaSSy-6 mutations + I112→Q97 | SaSSy-6 mutations + ATT→CAA | 266 | 262 | 156.07 |
| SaSSy-95 | 94 aa changes Identical to SaSSy-6 except contains L140→Y124 instead of L140→I124 | SaSSy-6 mutations, but with L140→Y124 | SaSSy-6 mutations, but with CTT→TAC | 249 | 227 | 127.82 |
| SaSSy-90 | 95 aa changes Identical to SaSSy-6 except also contains E487→S470 | SaSSy-6 mutations + E487→S470 | SaSSy-6 mutations + GAA→TCA | 245 | 222 | 151.92 |
| SaSSy-113 | 94 aa changes Identical to SaSSy-6 except contains S117→E102 | SaSSy-6 mutations, but with S117→E102 | SaSSy-6 mutations, but with AGC→GAG | 243 | 264 | 145.51 |
| SaSSy-131 | 94 aa changes Identical to SaSSy-6 except contains S117→E102 instead of S117→I102 | | AGC→GAA | 243 | 279 | 134.13 |
| SaSSy-130 | 94 aa changes Identical to SaSSy-6 except contains S117→D102 instead of S117→I102 | SaSSy-6 but with S117→D102 | AGC→GAT | 283 | 278 | 131.99 |
| SaSSy-132 | 94 aa changes Identical to SaSSy-6 except contains S117→N102 instead of S117→I102 | SaSSy-6 but with S117→N102 | AGC->AAT | 285 | 280 | 136.64 |
| SaSSy-120 | 95 aa changes Identical to Sassy-6 except also contains I56→R41 | SaSSy-6 mutations + I56→R41 | ATT->AGG | 251 | 229 | 121.80 |
| SaSSy-121 | 95 aa changes Identical to Sassy-6 except also contains I56→K41 | SaSSy-6 mutations + I56→K41 | ATT->AAA | 252 | 230 | 215.14 |

TABLE 11-continued

Identified Santalene Synthase Variants

| Variant | Description | Amino Acid Changes | Nucleotide Changes | SEQ ID NO aa | SEQ ID NO nuc | Total Terpene Production (% codon-optimized SaSSy) |
|---|---|---|---|---|---|---|
| SaSSy-122 | 95 aa changes Identical to SaSSy-6 except also contains S170→A154 | SaSSy-6 mutations + S170→A154 | AGC→GCG | 253 | 231 | 132.27 |
| SaSSy-123 | 95 aa changes Identical to SaSSy-6 except also contains T548→A531 | SaSSt-6 mutations + T548→A531 | ACG→GCA | 254 | 232 | 154.76 |
| SaSSy-124 | 95 aa changes Identical to SaSSy-6 except also contains T548→S531 | SaSSt-6 mutations + T548→A531 | ACG->AGT | 256 | 235 | 128.32 |
| SaSSy-125 | 96 aa changes Identical to SaSSy-6 except also contains T408→A391 and S480→A463 | SaSSy-6 mutations + T408→A391 and S480→A463 | ACG→GCT TCA→GCG | 257 | 237 | 177.72 |
| SaSSy-126 | 95 aa changes Identical to SaSSy-6 except also contains S518→E501 | SaSSy-6 mutations + S518→E501 | TCT→GAA | 259 | 238 | 175.30 |
| SaSSy-127 | 95 aa changes Identical to SaSSy-6 except also contains L64→Q49 | SaSSy-6 mutations + L64→Q49 | CTA→CAA | 260 | 240 | 162.29 |
| SaSSy-128 | 95 aa changes Identical to SaSSy-6 except also contains L64→E49 | SaSSy-6 mutations + L64→E49 | CTA→GAG | 261 | 241 | 211.94 |
| SaSSy-129 | 95 aa changes Identical to SaSSy-6 except also contains L452→I435 | SaSSy-6 mutations + L452→I435 | CTG→ATT | 277 | 242 | 144.26 |
| SaSSy-133 | 100 aa changes Identical to SaSSy-6 except contains K206→T189 instead of K206→Y189, and also contains K213→R196, Y379→I362, F385→L368, S395→A378, F403→Y386 and E487→A470 | SaSSy-6 but with K206→T189 + K213→R196, Y379→I362, F385→L368, S395→A378, F403→Y386 and E487→A470 | AAG→ACG AAG→AGG TAC→ATC TTT→TTG TCA→GCC TTC→TAT GAA→GCT | 286 | 281 | 115.14 |
| SaSSy-135 | 96 aa changes Identical to SaSSy-6 except contains K206→G189 instead of K206→Y189, and also contains N183→K167 and F282→W265 | SaSSy-6 but with K206→G189 + N183→K167 and F282→W265 | AAG→GGT AAC→AAA and TTT→TGG | 309 | 306 | 125.97 |
| SaSSy-136 | 96 aa changes Identical to SaSSy-6 except contains K206→S189 instead of K206→Y189, and also contains N183→K167 and F282→W265 | SaSSy-6 but with K206→S189 + N183→K167 and F282→W265 | AAG→TCT AAC→AAA and TTT→TGG | 310 | 307 | 144.92 |
| SaSSy-137 | 96 aa changes Identical to SaSSy-6 except contains K206→A189 instead of K206→Y189, and also contains N183→D167 and F282→W265 | SaSSy-6 but with K206→A189 + N183→D167 and F282→W265 | AAG→GCT AAC→GAC and TTT→TGG | 311 | 308 | 141.61 |
| | SaSSy/SspiSSy Hybrid replacement(s), N-terminal deletion and domain swaps | | | | | |
| SaSSy-44 | 99 aa changes Contains N-terminal deletion of aa 1-33 due to | M1→—— D2→—— S3→—— | ATG→—— GAT→—— TCT→—— | 168 | 86 | 106.04 |

TABLE 11-continued

Identified Santalene Synthase Variants

| Variant | Description | Amino Acid Changes | Nucleotide Changes | SEQ ID NO aa | SEQ ID NO nuc | Total Terpene Production (% codon-optimized SaSSy) |
|---|---|---|---|---|---|---|
| | M1V amino acid replacement Contains multiple domain swaps: AA 73-79 replaced with 94-100 of BDS AA 116-124 replaced with 93-100 of Citrus valencene synthase V19 AA 138-168 replaced with 114-144 of Citrus valencene synthase V19 (with variation) AA 198-207 replaced with 187-195 of VvCVS; and additional amino acid changes | S4→——<br>T5→——<br>A6→——<br>T7→——<br>A8→——<br>M9→——<br>T10→——<br>A11→——<br>P12→——<br>F13→——<br>I14→——<br>D15→——<br>P16→——<br>T17→——<br>D18→——<br>H19→——<br>V20→——<br>N21→——<br>L22→——<br>K23→——<br>T24→——<br>D25→——<br>T26→——<br>D27→——<br>A28→——<br>S29→——<br>E30→——<br>N31→——<br>R32→——<br>R33→——<br>K73→R40<br>F74→I41<br>M75→L42<br>F76→L43<br>G77→K44<br>A78→E45<br>P79→K46<br>K85→Q52<br>F101→L68<br>G116→H83<br>S117→I84<br>N118→D85<br>G119→S86<br>W120→D87<br>W121→——<br>F122→K88<br>G123→A89<br>H124→D90<br>C138→Q104<br>L140→I106<br>F141→K107<br>P143→S109<br>Q144→C110<br>K148→E114<br>T149→Q115<br>Q151→K117<br>N152→D118<br>K153→D119<br>T154→E120<br>G155→D121<br>E156→R122<br>D158→K124<br>M159→S125<br>K160→S126<br>C162→I128<br>D163→N129<br>N164→D130<br>V165→I131<br>K166→Q132<br>L168→M134 | TCC→——<br>ACC→——<br>GCC→——<br>ACC→——<br>GCC→——<br>ATG→——<br>ACA→——<br>GCT→——<br>CCA→——<br>TTC→——<br>ATT→——<br>GAT→——<br>CCT→——<br>ACT→——<br>GAT→——<br>CAT→——<br>GTG→——<br>AAT→——<br>CTC→——<br>AAA→——<br>ACT→——<br>GAT→——<br>ACG→——<br>GAT→——<br>GCC→——<br>TCA→——<br>GAG→——<br>AAT→——<br>CGA→——<br>AGG→——<br>AAG→AGA<br>TTT→ATC<br>ATG→TTG<br>TTT→TTG<br>GGG→AAA<br>GCA→GAA<br>CCA→AAG<br>AAG→CAA<br>TTT→TTG<br>GGG→CAT<br>AGC→ATC<br>AAT→GAT<br>GGA→TCT<br>TGG→GAT<br>TGG→——<br>TTT→AAG<br>GGC→GCT<br>CAC→GAC<br>TGT→CAA<br>CTT→ATC<br>TTT→AAG<br>CCC→TCC<br>CAA→TGC<br>AAA→GAA<br>ACG→CAA<br>CAA→AAG<br>AAC→GAT<br>AAG→GAC<br>ACT→GAA<br>GGG→GAT<br>GAA→AGA<br>GAT→AAG<br>ATG→TCC<br>AAA→TCC<br>TGT→ATT<br>GAC→AAC<br>AAC→GAC<br>GTA→ATC<br>AAA→CAA<br>CTG→ATG | | | |

TABLE 11-continued

Identified Santalene Synthase Variants

| Variant | Description | Amino Acid Changes | Nucleotide Changes | SEQ ID NO aa | SEQ ID NO nuc | Total Terpene Production (% codon-optimized SaSSy) |
|---|---|---|---|---|---|---|
| | | Y176→F142 | TAC→TTT | | | |
| | | T192→A158 | ACC→GCC | | | |
| | | C195→Y161 | TGC→TAC | | | |
| | | S198→A164 | AGT→GCT | | | |
| | | A199→M165 | GCA→ATG | | | |
| | | W200→V166 | TGG→GTT | | | |
| | | N202→S168 | AAT→TCT | | | |
| | | I203→L169 | ATA→TTG | | | |
| | | S204→G170 | TCC→GGT | | | |
| | | E205→—— | GAA→—— | | | |
| | | K206→Y171 | AAG→TAC | | | |
| | | W207→H172 | TGG→CAT | | | |
| | | A240→E205 | GCG→GAA | | | |
| | | G323→A288 | GGA→GCT | | | |
| | | I330→M295 | ATC→ATG | | | |
| | | V346→A311 | GTG→GCC | | | |
| | | K350→R315 | AAG→AGG | | | |
| | | N353→D318 | AAC→GAC | | | |
| | | S381→G346 | AGC→GGT | | | |
| | | F385→L350 | TTT→TTG | | | |
| | | S395→A360 | TCA→GCC | | | |
| | | F403→Y368 | TTC→TAT | | | |
| | | V433→I398 | GTG→ATT | | | |
| | | H446→R411 | CAC→AGA | | | |
| | | I465→M430 | ATA→ATG | | | |
| | | V502→I467 | GTA→ATC | | | |
| SaSSy-112 | 96 aa changes Contains N-terminal deletion of aa 1-33 also contains amino acid replacements similar to as SaSSy-44 except also contains S329→H294 but does not contain S381→G346, F385→L350, S395→A360 and F403→Y368 | SaSSy-44 mutations, but with S381→S346, F385→F350, S395→S360 and F403→F368 + S329→H294 | SaSSy-44 mutations, but with AGC→TCT, TTT→TTT, TCA→TCT and TTC→TTC + TCA→CAT | 267 | 263 | 68.15 |
| SaSSy/SspiSSy Hybrids containing domain swaps and additional amino acid replacements | | | | | | |
| SaSSy-5 | 68 aa changes Contains multiple domain swaps: AA 73-79 replaced with 94-100 of BDS AA 116-124 replaced with 93-100 of Citrus valencene synthase V19 AA 138-168 replaced with 114-144 of Citrus valencene synthase V19 (with variation) AA 198-207 replaced with 187-195 of VvCVS; and additional amino acid changes | M9T | ATG→ACT | 135 | 49 | 89.66 |
| | | D18N | GAT→AAT | | | |
| | | T24I | ACT→ATC | | | |
| | | T26N | ACG→AAC | | | |
| | | A28S | GCC→TCC | | | |
| | | K73R | AAG→AGA | | | |
| | | F74I | TTT→ATC | | | |
| | | M75L | ATG→TTG | | | |
| | | F76L | TTT→TTG | | | |
| | | G77K | GGG→AAA | | | |
| | | A78E | GCA→GAA | | | |
| | | P79K | CCA→AAG | | | |
| | | K85Q | AAG→CAA | | | |
| | | F101L | TTT→TTG | | | |
| | | G116H | GGG→CAT | | | |
| | | S117I | AGC→ATC | | | |
| | | N118D | AAT→GAT | | | |
| | | G119S | GGA→TCT | | | |
| | | W120D | TGG→GAT | | | |
| | | W121→—— | TGG→—— | | | |
| | | F122→K121 | TTT→AAG | | | |
| | | G123→A122 | GGC→GCT | | | |
| | | H124→D123 | CAC→GAC | | | |
| | | C138→Q137 | TGT→CAA | | | |
| | | L140→I139 | CTT→ATC | | | |
| | | F141→K140 | TTT→AAG | | | |
| | | P143→S142 | CCC→TCC | | | |
| | | Q144→C143 | CAA→TGC | | | |
| | | K148→E147 | AAA→GAA | | | |
| | | T149→Q148 | ACG→CAA | | | |

TABLE 11-continued

Identified Santalene Synthase Variants

| Variant | Description | Amino Acid Changes | Nucleotide Changes | SEQ ID NO aa | SEQ ID NO nuc | Total Terpene Production (% codon-optimized SaSSy) |
|---|---|---|---|---|---|---|
| | | Q151→K150 | CAA→AAG | | | |
| | | N152→D151 | AAC→GAT | | | |
| | | K153→D152 | AAG→GAC | | | |
| | | T154→E153 | ACT→GAA | | | |
| | | G155→D154 | GGG→GAT | | | |
| | | E156→R155 | GAA→AGA | | | |
| | | D158→K157 | GAT→AAG | | | |
| | | M159→S158 | ATG→TCC | | | |
| | | K160→S159 | AAA→TCC | | | |
| | | C162→I161 | TGT→ATT | | | |
| | | D163→N162 | GAC→AAC | | | |
| | | N164→D163 | AAC→GAC | | | |
| | | V165→I164 | GTA→ATC | | | |
| | | K166→Q165 | AAA→CAA | | | |
| | | L168→M167 | CTG→ATG | | | |
| | | Y176→F175 | TAC→TTT | | | |
| | | T192→A191 | ACC→GCC | | | |
| | | C195→Y194 | TGC→TAC | | | |
| | | S198→A197 | AGT→GCT | | | |
| | | A199→M198 | GCA→ATG | | | |
| | | W200→V199 | TGG→GTT | | | |
| | | N202→S201 | AAT→TCT | | | |
| | | I203→L202 | ATA→TTG | | | |
| | | S204→G203 | TCC→GGT | | | |
| | | E205→—— | GAA→—— | | | |
| | | K206→Y204 | AAG→TAC | | | |
| | | W207→H205 | TGG→CAT | | | |
| | | A240→E238 | GCG→GAA | | | |
| | | G323→A321 | GGA→GCT | | | |
| | | I330→M328 | ATC→ATG | | | |
| | | S381→G379 | AGC→GGT | | | |
| | | F385→L383 | TTT→TTG | | | |
| | | S395→A393 | TCA→GCC | | | |
| | | F403→Y401 | TTC→TAT | | | |
| | | V433→I431 | GTG→ATT | | | |
| | | H446→R444 | CAC→AGA | | | |
| | | I465→M463 | ATA→ATG | | | |
| | | V502→I500 | GTA→ATC | | | |
| SaSSy-43 | 72 aa changes Identical to SaSSy-5, except also contains V346→A344, K350→L348, N353→P351 and C483→R481 | SaSSy-5 mutations + V346→A344 K350→L348 N353→P351 C483→R481 | SaSSy-5 mutations + GTG→GCC AAG→CTA AAC→CCC TGT→CGC | 167 | 87 | 98.95 |
| SaSSy-76 | 71 aa changes Identical to SaSSy-5, except also contains V346→A344, K350→R348 and N353→D351 | SaSSy-5 mutations + V346→A344 K350→R348 N353→D351 | SaSSy-5 mutations + GTG→GCC AAG→AGG AAC→GAC | 191 | 120 | 102.34 |
| SaSSy-134 | 69 aa changes Contains multiple domain swaps: AA 73-79 replaced with 94-100 of BDS AA 116-124 replaced with 93-100 of Citrus valencene synthase V19 AA 138-168 replaced with 114-144 of Citrus valencene synthase V19 (with variation) AA 198-207 replaced with 187-195 of VvCVS; and additional amino acid changes | M9T D18N T24I T26N A28S K73R F74I M75L F76L G77K A78E P79K K85Q F101L G116H S117I N118D G119S W120D | ATG→ACT GAT→AAT ACT→ATC ACG→AAC GCC→TCC AAG→AGA TTT→ATC ATG→TTG TTT→TTG GGG→AAA GCA→GAA CCA→AAG AAG→CAA TTT→TTG GGG→CAT AGC→ATC AAT→GAT GGA→TCT TGG→GAT | 244 | 282 | 126.81 |

TABLE 11-continued

Identified Santalene Synthase Variants

| Variant | Description | Amino Acid Changes | Nucleotide Changes | SEQ ID NO aa | SEQ ID NO nuc | Total Terpene Production (% codon-optimized SaSSy) |
|---|---|---|---|---|---|---|
| | | W121→—— | TGG→—— | | | |
| | | F122→K121 | TTT→AAG | | | |
| | | G123→A122 | GGC→GCT | | | |
| | | H124→D123 | CAC→GAC | | | |
| | | C138→Q137 | TGT→CAA | | | |
| | | L140→I139 | CTT→ATC | | | |
|

TABLE 11-continued

Identified Santalene Synthase Variants

| Variant | Description | Amino Acid Changes | Nucleotide Changes | SEQ ID NO aa | SEQ ID NO nuc | Total Terpene Production (% codon-optimized SaSSy) |
|---|---|---|---|---|---|---|
| SaSSy-19 | 27 aa changes Contains one domain swap: 116-124 replaced with 93-100 of Citrus valencene synthase V19; and additional amino acid changes | T5S G116H S117I N118D G119S W120D W121→— F122→K121 G123→A122 H124→D123 T192→A191 C195→Y194 S198→N197 E205→Q204 A240→E239 G323→A322 I330→M329 L335→H334 S338→Y337 V346→A345 S381→G380 F385→L384 S395→A394 F403→Y402 V433→I432 I465→M464 V502→I501 | ACC→TCT GGG→CAT AGC→ATT AAT→GAT GGA→TCT TGG→GAT TGG→— TTT→AAA GGC→GCT CAC→GAT ACC→GCC TGC→TAC AGT→AAT GAA→CAA GCG→GAA GGA→GCT ATC→ATG CTC→CAT AGC→TAC GTG→GCC AGC→GGT TTT→CTT TCA→GCC TTC→TAT GTG→ATT ATA→ATG GTA→ATC | 147 | 63 | 115.05 |
| SaSSy-20 | 25 aa changes Contains one domain swap: 116-124 replaced with 93-100 of Citrus valencene synthase V19; and additional amino acid changes | G116H S117I N118D G119S W120D W121→— F122→K121 G123→A122 H124→D123 Y176→H175 T192→A191 C195→Y194 S198→N197 E205→Q204 A240→E239 G323→A322 I330→M329 L335→H334 S338→Y337 S381→G380 S395→A394 F403→Y402 V433→I432 I465→M464 V502→I501 | GGG→CAT AGC→ATT AAT→GAT GGA→TCT TGG→GAT TGG→— TTT→AAA GGC→GCT CAC→GAT TAC→CAC ACC→GCC TGC→TAC AGT→AAT GAA→CAA GCG→GAA GGA→GCT ATC→ATG CTC→CAT AGC→TAC AGC→GGT TCA→GCC TTC→TAT GTG→ATT ATA→ATG GTA→ATC | 148 | 64 | 117.14 |
| SaSSy-21 | 24 aa changes Contains one domain swap: 116-124 replaced with 93-100 of Citrus valencene synthase V19; and additional amino acid changes | G116H S117I N118D G119S W120D W121→— F122→K121 G123→A122 H124→D123 T192→A191 C195→Y194 S198→N197 E205→Q204 A240→E239 G323→A322 I330→M329 L335→H334 S338→Y337 | GGG→CAT AGC→ATT AAT→GAT GGA→TCT TGG→GAT TGG→— TTT→AAA GGC→GCT CAC→GAT ACC→GCC TGC→TAC AGT→AAT GAA→CAA GCG→GAA GGA→GCT ATC→ATG CTC→CAT AGC→TAC | 149 | 65 | 102.85 |

TABLE 11-continued

Identified Santalene Synthase Variants

| Variant | Description | Amino Acid Changes | Nucleotide Changes | SEQ ID NO aa | SEQ ID NO nuc | Total Terpene Production (% codon-optimized SaSSy) |
|---|---|---|---|---|---|---|
| | | S381→G380 | AGC→GGT | | | |
| | | S395→A394 | TCA→GCC | | | |
| | | F403→Y402 | TTC→TAT | | | |
| | | V433→I432 | GTG→ATT | | | |
| | | I465→M464 | ATA→ATG | | | |
| | | V502→I501 | GTA→ATC | | | |
| SaSSy-23 | 35 aa changes Contains one domain swap: 138-168 replaced with 114-144 of Citrus valencene synthase V19; and additional amino acid changes | C138Q | TGT→CAA | 151 | 67 | 109.44 |
| | | L140I | CTT→ATT | | | |
| | | F141K | TTT→AAG | | | |
| | | P143S | CCC→TCT | | | |
| | | Q144C | CAA→TGT | | | |
| | | K148E | AAA→GAA | | | |
| | | T149Q | ACG→CAA | | | |
| | | Q151K | CAA→AAG | | | |
| | | N152D | AAC→GAT | | | |
| | | K153D | AAG→GAT | | | |
| | | T154E | ACT→GAA | | | |
| | | E156R | GAA→AGA | | | |
| | | D158K | GAT→AAA | | | |
| | | M159S | ATG→AGT | | | |
| | | K160S | AAA→TCT | | | |
| | | C162I | TGT→ATT | | | |
| | | D163N | GAC→AAT | | | |
| | | N164D | AAC→GAT | | | |
| | | K166Q | AAA→CAA | | | |
| | | L168M | CTG→ATG | | | |
| | | T192A | ACC→GCC | | | |
| | | C195Y | TGC→TAC | | | |
| | | S198N | AGT→AAT | | | |
| | | E205Q | GAA→CAA | | | |
| | | A240E | GCG→GAA | | | |
| | | G323A | GGA→GCT | | | |
| | | I330M | ATC→ATG | | | |
| | | L335H | CTC→CAT | | | |
| | | S338Y | AGC→TAC | | | |
| | | S381G | AGC→GGT | | | |
| | | S395A | TCA→GCC | | | |
| | | F403Y | TTC→TAT | | | |
| | | V433I | GTG→ATT | | | |
| | | I465M | ATA→ATG | | | |
| | | V502I | GTA→ATC | | | |
| SaSSy-24 | 36 aa changes Contains one domain swap: 138-168 replaced with 114-144 of Citrus valencene synthase V19; and additional amino acid changes | C138Q | TGT→CAA | 152 | 68 | 106.00 |
| | | L140I | CTT→ATT | | | |
| | | F141K | TTT→AAG | | | |
| | | P143S | CCC→TCT | | | |
| | | Q144C | CAA→TGT | | | |
| | | K148E | AAA→GAA | | | |
| | | T149Q | ACG→CAA | | | |
| | | Q151K | CAA→AAG | | | |
| | | N152D | AAC→GAT | | | |
| | | K153D | AAG→GAT | | | |
| | | T154E | ACT→GAA | | | |
| | | E156R | GAA→AGA | | | |
| | | D158K | GAT→AAA | | | |
| | | M159S | ATG→AGT | | | |
| | | K160S | AAA→TCT | | | |
| | | C162I | TGT→ATT | | | |
| | | D163N | GAC→AAT | | | |
| | | N164D | AAC→GAT | | | |
| | | K166Q | AAA→CAA | | | |
| | | L168M | CTG→ATG | | | |
| | | T192A | ACC→GCC | | | |
| | | C195Y | TGC→TAC | | | |
| | | S198N | AGT→AAT | | | |
| | | E205Q | GAA→CAA | | | |
| | | A240E | GCG→GAA | | | |
| | | G323A | GGA→GCT | | | |
| | | I330M | ATC→ATG | | | |
| | | L335H | CTC→CAT | | | |
| | | S338Y | AGC→TAC | | | |

TABLE 11-continued

Identified Santalene Synthase Variants

| Variant | Description | Amino Acid Changes | Nucleotide Changes | SEQ ID NO aa | SEQ ID NO nuc | Total Terpene Production (% codon-optimized SaSSy) |
|---|---|---|---|---|---|---|
| | | S381G | AGC→GGT | | | |
| | | S395A | TCA→GCC | | | |
| | | F403Y | TTC→TAT | | | |
| | | V433I | GTG→ATT | | | |
| | | I465M | ATA→ATG | | | |
| | | V502I | GTA→ATC | | | |
| | | Q521R | CAG→CGA | | | |
| | | Other | | | | |
| SaSSy-93 | n/a | n/a | n/a | n/a | n/a | 142.70 |
| SaSSy-49 | n/a | n/a | n/a | n/a | n/a | 130.85 |
| SaSSy-86 | n/a | n/a | n/a | n/a | n/a | 116.19 |
| SaSSy-98 | | | | | | 118.12 |
| SaSSy-99 | | | | | | 116.37 |
| SaSSy-100 | | | | | | 115.28 |

2. Product Profile

Tables 12-19 below set forth the product profiles of SaSSy variants set forth in Table 11 above compared to codon-optimized SaSSy. The Tables indicate the percent production of α-santalene, β-santalene and α-exo-bergamotene as a percentage of the production of α-santalene, β-santalene and α-exo-bergamotene for the codon-optimized SaSSy enzyme. A percentage greater than 100% indicates an increase in production as compared to codon-optimized SaSSy and a percentage less than 100% indicates a decrease in production as compared to codon-optimized SaSSy for the noted terpene product.

As shown in the Tables below, the control codon-optimized SaSSy enzyme produced: 45.7% alpha-santalene, 26.12% beta-santalene and 30.40% alpha-exo-bergamotene. A difference in product profile of greater than 3% is significant, and smaller percent changes also can represent important differences in product profile. For example, comparing the product profile produced from 16 flasks of wild type SaSSy to 16 flasks of codon-optimized SaSSy, the alpha-santalene percent of production by codon-optimized SaSSy was 97% of alpha-santalene percent production by wild-type SaSSy. By Student's t-test comparing the product profiles of the two groups of flasks, this difference was significant with p<<0.01. A similar comparison of the beta santalene data showed that a difference of 4% was very highly significant (about $p \ll 10^{-6}$).

Tables 12-19 below indicate that some variants had no change in product profile compared to the codon-optimized SaSSy (see Table 12), whereas other variants had altered product profiles, such as increased or decreased production of α-santalene, β-santalene or α-exo-bergamotene (see Tables 13-19).

a. No Change in Product Profile

The SaSSy variants in Table 12, while exhibiting an increase in total production (see Table 11 above), generally exhibited the same product profile as codon-optimized SaSSy.

TABLE 12

Product Profiles for SaSSy Variants (product profile as a % of production of codon-optimized SaSSy, e.g., codon-optimized SaSSy production = 100%)

| Name | SEQ ID NO aa | SEQ ID NO nuc | Alpha-santalene 45.7% of production = 100% (27 experiments, std dev = 1.03) | Beta-santalene 26.12% of production = 100% (27 experiments, std dev = 0.64) | Alpha-exo-bergamotene 30.40% of production = 100% (27 experiments, std dev = 1.43) |
|---|---|---|---|---|---|
| Codon-optimized SaSSy | 1 | 3 | | | |
| SaSSy-8 | 138 | 52 | 100.36 | 98.61 | 100.67 |
| SaSSy-9 | | 53 | 100.51 | 98.76 | 100.32 |
| SaSSy-63 | 185 | 107 | 101.8 | 96.7 | 100.3 |
| SaSSy-66 | | 110 | 102.2 | 96.2 | 100.0 |
| SaSSy-49 | n/a | n/a | 100.83 | 101.00 | 98.54 |
| SaSSy-51 | 175 | 95 | 101.31 | 103.47 | 96.64 |
| SaSSy-7 | 137 | 51 | 99.25 | 97.97 | 102.83 |
| SaSSy-85 | 195 | 129 | 99.57 | 96.88 | 102.60 |
| SaSSy-50 | 174 | 94 | 99.11 | 98.44 | 101.84 |
| SaSSy-46 | 170 | 90 | 99.19 | 97.78 | 102.13 |
| SaSSy-47 | 171 | 91 | 99.44 | 97.65 | 101.92 |
| SaSSy-26 | 154 | 70 | 99.80 | 99.57 | 100.68 |
| SaSSy-92 | 246 | 224 | 100.22 | 96.87 | 101.86 |
| SaSSy-94 | 248 | 226 | 100.18 | 98.25 | 100.97 |
| SaSSy-111 | 266 | 262 | 100.04 | 98.70 | 101.08 |
| SaSSy-120 | 251 | 229 | 99.37 | 98.96 | 102.05 |
| SaSSy-121 | 252 | 230 | 100.56 | 100.45 | 98.70 |
| SaSSy-122 | 253 | 231 | 99.80 | 100.20 | 100.15 | b. Increased Production of α- and/or β-Santalene and Decreased Production of α-Exo-Bergamotene The variants in Table 13 produced increased amounts of both alpha- and beta-santalene and decreased amounts of alpha-exo-bergamotene as compared to codon-optimized SaSSy.

For example, the results show that mutants that incorporate the V346A mutation (e.g., SaSSy-1) have an improved santalene product profile compared to the same variants that do not contain the V346A mutation (e.g., SaSSy-37). For example, incorporation of the V346A mutation into SaSSy-1 resulted in increased proportion of β-santalene such that SaSSy-1 produced 123.01% β-santalene versus 105.74% by SaSSy-37 not containing V346A.

Also, amino acid replacement F282W confers a substantial reduction in the proportion of bergamotene, thus increasing the overall proportion of alpha- and beta-santalene with the profile (see e.g., SaSSy-55, SaSSy-101, SaSSy-102, SaSSy-135).

The results also show that SaSSy-10, containing a modified N-terminus, produced 15.79% and 31.04% more α- and β-santalene, respectively, and 49.44% less α-exo-bergamotene than codon-optimized SaSSy.

TABLE 13

Product Profiles for SaSSy Variants (product profile as a % of production of codon-optimized SaSSy, e.g., codon-optimized SaSSy production = 100%)

| Name Codon-optimized SaSSy | SEQ ID NO aa | SEQ ID NO nuc | Alpha-santalene 45.7% of production = 100%(27 experiments, std dev = 1.03) | Beta-santalene 26.12% of production = 100%(27 experiments, std dev = 0.64) | Alpha-exo-bergamotene 30.40% of production = 100%(27 experiments, std dev = 1.43) |
|---|---|---|---|---|---|
| SaSSy-101 | 179 | 304 | 116.11 | 152.67 | 49.73 |
| SaSSy-55 | | | 108.24 | 142.64 | 55.98 |
| SaSSy-102 | 180 | 234 | 115.52 | 150.50 | 51.71 |
| SaSSy-10 | 139 | 54 | 115.79 | 131.04 | 50.56 |
| SaSSy-1 | 131 | 45 | 107.80 | 123.01 | 70.80 |
| SaSSy-48 | 172 | 92 | 110.29 | 114.99 | 80.50 |
| SaSSy-19 | 147 | 63 | 107.71 | 106.51 | 80.56 |
| SaSSy-104 | 255 | 236 | 104.73 | 111.82 | 82.44 |
| SaSSy-67 | 188 | 111 | 105.5 | 105.2 | 86.2 |
| SaSSy-14 | 142 | 58 | 104.53 | 105.03 | 89.72 |
| SaSSy-134 | 244 | 282 | 109.60 | 171.69 | 36.58 |
| SaSSy-119 | 247 | 225 | 112.27 | 138.72 | 56.59 |
| SaSSy-133 | 286 | 281 | 104.10 | 113.85 | 84.84 |
| SaSSy-135 | 309 | 306 | 110.16 | 145.69 | 48.45 | c. Knock Out or Significantly Reduce Production of α- and β-Santalene

The variants in Table 14 produced significantly smaller amounts of alpha- and beta-santalene as compared to codon-optimized SaSSy. These variants produced predominantly alpha-exo-bergamotene. For example, SaSSy-43, which is the only identified variant containing a replacement at position 483 (e.g., C483R), produced only 8.53% and 5.37% α- and β-santalene, respectively, as compared to codon-optimized SaSSy. For SaSSy-44, which is presumed to lack amino acids 1-33 at the N-terminus due to the amino acid replacement M1V, 78% of the total product was alpha-exo-bergamotene. SaSSy-112, which was generated to be an N-terminal truncation lacking amino acids 1-33 at the N-terminus, also produced predominantly alpha-exo-bergamotene as the product. Also, variants SaSSy-123 and SaSSy-124, which each contain a replacement at position 548 (T548A and T548S, respectively), also show predominant production of alpha-exo-bergamotene compared to the other products, although they exhibit a lesser increased production of alpha-exo-bergamotene than the above variants.

TABLE 14

Product Profiles for SaSSy Variants (product profile as a % of production of codon-optimized SaSSy, e.g., codon-optimized SaSSy production = 100%)

| Name Codon-optimized SaSSy | SEQ ID NO aa | SEQ ID NO nuc | Alpha-santalene 45.7% of production = 100% (27 experiments, std dev = 1.03) | Beta-santalene 26.12% of production = 100% (27 experiments, std dev = 0.64) | Alpha-exo-bergamotene 30.40% of production = 100% (27 experiments, std dev = 1.43) |
|---|---|---|---|---|---|
| SaSSy-43 | 167 | 87 | 8.53 | 5.37 | 86.10 |
| SaSSy-44 | 168 | 86 | 30.07 | 27.74 | 289.47 |
| SaSSy-112 | 267 | 263 | 11.58 | 6.29 | 319.05 |
| SaSSy-123 | 254 | 232 | 41.46 | 35.90 | 260.03 |
| SaSSy-124 | 256 | 235 | 77.50 | 74.87 | 161.97 | d. Decreased Production of α- and/or β-Santalene and Increased Production of α-Exo-Bergamotene The variants in Table 15 produced increased amounts of α-exo-bergamotene and decreased amounts of α- and β-santalene as compared to codon-optimized SaSSy. For example, SaSSy-12 produced 24.70% more α-exo-bergamotene and 9.82% and 13.91% less α- and β-santalene, respectively, as compared to codon-optimized SaSSy.

TABLE 15

Product Profiles for SaSSy Variants (product profile as a % of production of codon-optimized SaSSy, e.g., codon-optimized SaSSy production = 100%)

| Name Codon-optimized SaSSy | SEQ ID NO aa | SEQ ID NO nuc | Alpha-santalene 45.7% of production = 100% (27 experiments, std dev = 1.03) | Beta-santalene 26.12% of production = 100% (27 experiments, std dev = 0.64) | Alpha-exo-bergamotene 30.40% of production = 100% (27 experiments, std dev = 1.43) |
|---|---|---|---|---|---|
| SaSSy-3 | 133 | 47 | 95.31 | 96.07 | 112.08 |
| SaSSy-39 | | 83 | 96.19 | 98.08 | 107.00 |
| SaSSy-40 | | 84 | 97.36 | 95.94 | 108.08 |
| SaSSy-62 | | 106 | 101.1 | 96.0 | 102.0 |
| SaSSy-4 | 134 | 48 | 96.05 | 100.22 | 106.61 |
| SaSSy-6 | 136 | 50 | 97.45 | 98.49 | 105.82 |
| SaSSy-41 | | 85 | 98.10 | 97.02 | 104.69 |
| | | 96 | 97.52 | 95.54 | 106.83 |
| SaSSy-56 | | 100 | 95.91 | 96.44 | 108.93 |
| SaSSy-61 | | 105 | 95.29 | 96.70 | 109.64 |
| SaSSy-68 | | 112 | 96.31 | 94.09 | 111.35 |
| SaSSy-69 | | 113 | 98.08 | 94.02 | 108.60 |
| SaSSy-70 | | 114 | 97.63 | 93.32 | 109.95 |
| SaSSy-71 | | 115 | 97.26 | 93.93 | 109.98 |
| SaSSy-73 | | 117 | 95.18 | 96.12 | 110.26 |
| SaSSy-75 | | 119 | 97.83 | 94.18 | 105.62 |
| SaSSy-79 | | 123 | 99.61 | 97.36 | 102.04 |
| SaSSy-87 | | 219 | 97.12 | 93.26 | 106.89 |
| SaSSy-88 | | 220 | 97.63 | 93.76 | 106.08 |
| SaSSy-115 | | 81 | 95.19 | 93.00 | 111.99 |
| SaSSy-114 | | 265 | 97.23 | 97.22 | 106.73 |
| SaSSy-11 | 140 | 55 | 90.93 | 88.64 | 121.63 |
| SaSSy-12 | | 56 | 90.18 | 86.09 | 124.70 |
| SaSSy-38 | 165 | 82 | 95.64 | 98.60 | 107.30 |
| SaSSy-53 | 177 | 97 | 96.80 | 95.14 | 108.13 |
| SaSSy-84 | | 128 | 99.00 | 96.33 | 103.63 |
| SaSSy-91 | | 223 | 99.14 | 95.61 | 103.96 |
| SaSSy-54 | 178 | 98 | 97.19 | 94.58 | 108.02 |
| SaSSy-82 | | 126 | 98.86 | 95.06 | 104.65 |
| SaSSy-59 | 183 | 103 | 96.74 | 94.66 | 109.17 |
| SaSSy-60 | 184 | 104 | 96.39 | 93.45 | 110.68 |
| SaSSy-64 | 186 | 108 | 95.5 | 88.6 | 118.0 |
| SaSSy-72 | 189 | 116 | 96.47 | 95.89 | 108.56 |
| SaSSy-74 | 190 | 118 | 97.09 | 93.77 | 106.64 |
| SaSSy-77 | 192 | 121 | 92.29 | 88.21 | 115.91 |
| SaSSy-78 | 193 | 122 | 97.66 | 95.13 | 105.62 |
| SaSSy-80 | | 124 | 99.00 | 96.95 | 102.99 |
| SaSSy-81 | | 125 | 97.53 | 95.06 | 105.81 |
| SaSSy-83 | 194 | 127 | 96.83 | 93.20 | 108.26 |
| SaSSy-90 | 245 | 222 | 95.78 | 98.28 | 108.19 |
| SaSSy-95 | 249 | 227 | 95.44 | 92.33 | 110.46 |
| SaSSy-125 | 257 | 237 | 83.45 | 86.45 | 138.18 |
| SaSSy-117 | 196 | 99 | 94.33 | 89.98 | 117.77 |
| SaSSy-127 | 260 | 240 | 97.48 | 95.92 | 107.57 |
| SaSSy-128 | 261 | 241 | 97.83 | 96.12 | 106.84 |
| SaSSy-118 | 233 | 130 | 97.31 | 94.91 | 107.60 |
| SaSSy-129 | 277 | 242 | 92.19 | 86.82 | 120.84 |
| SaSSy-130 | 283 | 278 | 96.60 | 93.85 | 109.38 |
| SaSSy-131 | 243 | 279 | 97.25 | 94.91 | 107.68 |
| SaSSy-113 | | 264 | 96.91 | 96.92 | 107.49 |
| SaSSy-132 | 285 | 280 | 96.98 | 94.45 | 108.39 | e. No Change in Production of α- and β-Santalene and Increased Production of α-Exo-Bergamotene The variants in Table 16 produced increased amounts of alpha-exo-bergamotene with no change in the production of alpha- and beta-santalene as compared to codon-optimized SaSSy.

TABLE 16

Product Profiles for SaSSy Variants (product profile as a % of production of codon-optimized SaSSy, e.g., codon-optimized SaSSy production = 100%)

| Name Codon-optimized SaSSy | SEQ ID NO aa | SEQ ID NO nuc | Alpha-santalene 45.7% of production = 100% (27 experiments, std dev = 1.03) | Beta-santalene 26.12% of production = 100% (27 experiments, std dev = 0.64) | Alpha-exo-bergamotene 30.40% of production = 100% (27 experiments, std dev = 1.43) |
|---|---|---|---|---|---|
| SaSSy-45 | 169 | 89 | 97.92 | 96.52 | 106.92 |
| SaSSy-58 | 182 | 102 | 96.58 | 98.03 | 106.64 |
| SaSSy-25 | 153 | 69 | 97.82 | 99.21 | 104.03 |
| SaSSy-116 | 164 | 93 | 98.51 | 97.01 | 104.98 |
| SaSSy-126 | 259 | 238 | 98.37 | 97.40 | 104.86 | f. No Change in Production of α-Santalene, Increased Production of β-Santalene and Decreased Production of α-Exo-Bergamotene The variants in Table 17 produced increased amounts of β-santalene and decreased amounts of α-exo-bergamotene with no change in the amount of α-santalene produced. For example, SaSSy-57, which contains the amino acid replacements I313L and H404Y, produced 27.37% more β-santalene and 23.91% less α-exo-bergamotene than codon-optimized SaSSy. SaSSy-136, which contains amino acid replacements K206S/N183K/F282W, produced 34.73% more β-santalene and 44.43% less α-exo-bergamotene than codon-optimized SaSSy. SaSSy-137, which contains amino acid replacements K206A/N183D/F282W, produced 34.50% more β-santalene and 44.63% less α-exo-bergamotene than codon-optimized SaSSy.

TABLE 17

Product Profiles for SaSSy Variants (product profile as a % of production of codon-optimized SaSSy, e.g., codon-optimized SaSSy production = 100%)

| Name Codon-optimized SaSSy | SEQ ID NO aa | SEQ ID NO nuc | Alpha-santalene 45.7% of production = 100% (27 experiments, std dev = 1.03) | Beta-santalene 26.12% of production = 100% (27 experiments, std dev = 0.64) | Alpha-exo-bergamotene 30.40% of production = 100% (27 experiments, std dev = 1.43) |
|---|---|---|---|---|---|
| SaSSy-57 | 181 | 101 | 100.95 | 127.37 | 76.09 |
| SaSSy-5 | 135 | 49 | 101.85 | 119.31 | 78.46 |
| SaSSy-76 | 191 | 120 | 101.23 | 112.54 | 85.74 |
| SaSSy-42 | 166 | 86 | 99.08 | 106.95 | 95.92 |
| SaSSy-86 | n/a | n/a | 100.78 | 106.74 | 93.53 |
| SaSSy-37 | 288 | 287 | 101.28 | 105.74 | 93.63 |
| SaSSy-96 | 250 | 228 | 99.63 | 105.27 | 96.88 |
| SaSSy-13 | 141 | 57 | 101.92 | 104.55 | 93.71 |
| SaSSy-22 | 150 | 66 | 101.96 | 103.07 | 93.65 |
| SaSSy-136 | 310 | 307 | 101.55 | 134.73 | 55.57 |
| SaSSy-137 | 311 | 308 | 101.91 | 134.50 | 55.37 | g. Increased Production of α-Santalene, No Change in Production of β-Santalene and Decreased Production of α-Exo-Bergamotene Variant SaSSy-18 in Table 18 produced increased amounts of alpha-santalene and decreased amounts of alpha-exo-bergamotene, with no change in the production of beta-santalene as compared to codon-optimized SaSSy.

TABLE 18

Product Profiles for SaSSy Variants (product profile as a % of production of codon-optimized SaSSy, e.g., codon-optimized SaSSy production = 100%)

| Name Codon-optimized SaSSy | SEQ ID NO aa | SEQ ID NO nuc | Alpha-santalene 45.7% of production = 100% | Beta-santalene 26.12% of production = 100% | Alpha-exo-bergamotene 30.40% of production = 100% |
|---|---|---|---|---|---|
| | 1 | 3 | (27 experiments, std dev = 1.03) | (27 experiments, std dev = 0.64) | (27 experiments, std dev = 1.43) |
| SaSSy-18 | 146 | 62 | 112.67 | 102.83 | 75.86 | h. Increased Production of α-Santalene, Decreased Production of β-Santalene and Increased Production of α-Exo-Bergamotene The variants in Table 19 produced increased amounts of alpha-santalene and alpha-exo-bergamotene and decreased amounts of beta-santalene as compared to codon-optimized SaSSy. For example, the SaSSy/SspiSSy hybrid (SaSSy-2) had a slightly different terpene product profile than the codon-optimized SaSSy enzyme. The total of the α-santalene and β-santalene production was approximately 2% lower in the SaSSy/SspiSSy hybrid than in the codon-optimized SaSSy enzyme.

TABLE 19

Product Profiles for SaSSy Variants (product profile as a % of production of codon-optimized SaSSy, e.g., codon-optimized SaSSy production = 100%)

| Name Codon-optimized SaSSy | SEQ ID NO aa | SEQ ID NO nuc | Alpha-santalene 45.7% of production = 100% | Beta-santalene 26.12% of production = 100% | Alpha-exo-bergamotene 30.40% of production = 100% |
|---|---|---|---|---|---|
| | 1 | 3 | (27 experiments, std dev = 1.03) | (27 experiments, std dev = 0.64) | (27 experiments, std dev = 1.43) |
| SaSSy-21 | 149 | 65 | 104.77 | 86.89 | 105.01 |
| SaSSy-20 | 148 | 64 | 104.96 | 87.10 | 104.47 |
| SaSSy-2 | 132 | 46 | 103.76 | 84.52 | 109.06 |
| SaSSy-23 | 151 | 67 | 102.77 | 83.53 | 111.71 |
| SaSSy-24 | 152 | 68 | 102.74 | 83.21 | 112.08 |

Example 5

Santalene Synthase Variants with Increased Total Terpene Production and Altered Profile This example summarizes data for modified synthases that the catalyze increased total terpene production and also have an altered terpene profile, producing increased α- and/or β-santalene and decreased α-exo-bergamotene and other products compared to the production of wild-type SaSSy encoded by codon-optimized nucleic acid (codon-optimized SaSSy, set forth in SEQ ID NO:3). The clones and terpene production data are from the above examples.

TABLE 20

Structure of SaSSy variants that catalyze increased terpene production and increased α-santalene and β-santalene

| Variant Name | Amino Acid Replacement(s) or Deletions | Domain Swap(s) | aa | na |
|---|---|---|---|---|
| SaSSy-55 & SaSSy-101 | K85Q/F101L/Y176F/T192A/C195Y/ K206T/A240E/F282W/G323A/S329H/ I330M/V346A/K350R/N353D/V433I/ H446R/I465M/V502I | SaSSy1-31swapHVS1-16/ SaSSy73-79swapBDS94-100/ SaSSY116-124swapCVS(V19)93-100/ SaSSy138-168swapCVS(V19)114-144**/ SaSSy198-207swapCVS(Vv)187-195(K206T) | 179 179 | 304 304 |
| SaSSy-1 | V356A/F385L | SaSSY116-124swapCVS(V19)93-100 | 131 | 45 |
| SaSSy-48 | A28G/K85Q/F101L/Y176F/T192A/ C195Y/A240E/G323A/S329H/I330M/ | SaSSy1-31 swapHVS1-16/ SaSSy73-79swapBDS94-100/ | 172 | 92 |

TABLE 20-continued

Structure of SaSSy variants that catalyze increased terpene production and increased α-santalene and β-santalene

| Variant Name | Amino Acid Replacement(s) or Deletions | Domain Swap(s) | aa | na |
|---|---|---|---|---|
| | V346A/K350R/N353D/V433I/H446R/I465M/V502I | SaSSY116-124swapCVS(V19)93-100/<br>SaSSy138-168swapCVS(V19)114-144**/<br>SaSSy198-207swapCVS(Vv)187-195 | | |
| SaSSy-19 | T5S/T192A/C195Y/S198N/E205Q/A240E/G323A/I330M/L335H/S338Y/V346A/S381G/F385L/S395A/F403Y/V433I/I465M/V502I | SaSSY116-124swapCVS(V19)93-100 | 147 | 63 |
| SaSSy-104 | A28G/K85Q/F101L/Y176F/T192A/C195Y/A240E/G323A/S329H/I330M/V346A/K350R/N353D/V433I/H446R/I465M/V502I | SaSSy1-31swapHVS1-16(A28G)/<br>SaSSy73-79swapBDS94-100/<br>SaSSY116-124swapCVS(V19)93-100(S117S)I<br>SaSSy138-168swapCVS(V19)114-144**/<br>SaSSy198-207swapCVS(Vv)187-195 | 255 | 236 |
| SaSSy-67 | K85Q/F101L/Y176F/T192A/C195Y/A240E/G323A/S329H/I330M/C345P/V433I/H446R/I465M/V502I | SaSSy1-31swapHVS1-16/<br>SaSSy73-79swapBDS94-100/<br>SaSSY116-124swapCVS(V19)93-100/<br>SaSSy138-168swapCVS(V19)114-144**/<br>SaSSy198-207swapCVS(Vv)187-195 | 188 | 111 |
| SaSSy-14 | M9V | SaSSy116-124swapBDS137-149 | 142 | 58 |
| SaSSy-134 | M9T/D18N/T24I/T26N/A28S/K85Q/F101L/Y176F/T192A/C195Y/A240E/G323A/S329H/I330M/R342G/V346A/K350R/N353D/V433I/H446R/I465M/V502I | SaSSy73-79swapBDS94-100/<br>SaSSY116-124swapCVS(V19)93-100/<br>SaSSy138-168swapCVS(V19)114-144**/<br>SaSSy198-207swapCVS(Vv)187-195 | 244 | 282 |
| SaSSy-119 | K85Q/F101L/Y176F/T192A/C195Y/K206T/A240E/F282W/G323A/S329H/I330M/V346A/K350R/N353D/V433I/H446R/I465M/V502I | SaSSy1-31swapHVS1-16/<br>SaSSy73-79swapBDS94-100/<br>SaSSY116-124swapCVS(V19)93-100/<br>SaSSy138-168swapCVS(V19)114-144**/<br>SaSSy198-207swapCVS(Vv)187-195(K206T) | 247 | 225 |
| SaSSy-133 | K85Q/F101L/Y176F/T192A/C195Y/K206T/K213R/A240E/G323A/S329H/I330M/V346A/K350R/N353D/Y379I/F385L/S395A/F403Y/V433I/H446R/I465M/E487A/V502I | SaSSy1-31swapHVS1-16/<br>SaSSy73-79swapBDS94-100/<br>SaSSY116-124swapCVS(V19)93-100/<br>SaSSy138-168swapCVS(V19)114-144**/<br>SaSSy198-207swapCVS(Vv)187-195(K206T) | 286 | 281 |
| SaSSy-135 | K85Q/F101L/Y176F/N183K/T192A/C195Y/K206G/A240E/F282W/G323A/S329H/I330M/V346A/K350R/N353D/V433I/H446R/I465M/V502I | SaSSy1-31swapHVS1-16/<br>SaSSy73-79swapBDS94-100/<br>SaSSY116-124swapCVS(V19)93-100/<br>SaSSy138-168swapCVS(V19)114-144**/<br>SaSSy198-207swapCVS(Vv)187-195(K206G) | 309 | 306 |
| SaSSy-76 | M9T/D18N/T24I/T26N/A28S/K85Q/F101L/Y176F/T192A/C195Y/A240E/G323A/I330M/V346A/K350R/N353D/S381G/F385L/S395A/F403Y/V433I/H446R/I465M/V502I | SaSSy73-79swapBDS94-100/<br>SaSSY116-124swapCVS(V19)93-100/<br>SaSSy138-168swapCVS(V19)114-144**/<br>SaSSy198-207swapCVS(Vv)187-195 | 191 | 120 |
| SaSSy-42 | K85Q/F101L/Y176F/T192A/C195Y/A240E/G323A/S329H/I330M/V346A/K350R/N353D/S381P/F385L/V433I/H446R/I465M/V502I | SaSSy1-31swapHVS1-16/<br>SaSSy73-79swapBDS94-100/<br>SaSSY116-124swapCVS(V19)93-100/<br>SaSSy138-168swapCVS(V19)114-144**/<br>SaSSy198-207swapCVS(Vv)187-195 | 166 | 86 |
| SaSSy-37 | — | SaSSY116-124swapCVS(V19)93-100 | 288 | 287 |

TABLE 20-continued

Structure of SaSSy variants that catalyze increased terpene production and increased α-santalene and β-santalene

| Variant Name | Amino Acid Replacement(s) or Deletions | Domain Swap(s) | aa | na |
|---|---|---|---|---|
| SaSSy-96 | K85Q/F101L/Y176F/T192A/C195Y/ A240E/G323A/S329H/I330M/V346A/ K350R/N353D/F385L/V433I/H446R/ I465M/V502I | SaSSy1-31swapHVS1-16/ SaSSy73-79swapBDS94-100/ SaSSY116-124swapCVS(V19)93-100/ SaSSy138-168swapCVS(V19)114-144**/ SaSSy198-207swapCVS(Vv)187-195 | 250 | 228 |
| SaSSy-13 | K73E | SaSSY116-124swapCVS(Vv)104-113 | 141 | 57 |
| SaSSy-136 | K85Q/F101L/Y176F/N183K/T192A/ C195Y/K206S/A240E/F282W/G323A/ S329H/I330M/V346A/K350R/N353 D/V433I/H446R/I465M/V502I | SaSSy1-31swapHVS1-16/ SaSSy73-79swapBDS94-100/ SaSSY116-124swapCVS(V19)93-100/ SaSSy138-168swapCVS(V19)114-144**/ SaSSy198-207swapCVS(Vv)187-195(K2065) | 310 | 307 |
| SaSSy-137 | K85Q/F101L/Y176F/N183D/T192A/ C195Y/K206A/A240E/F282W/G323 A/S329H/I330M/V346A/K350R/N35 3D/V433I/H446R/I465M/V502I | SaSSy1-31swapHVS1-16/ SaSSy73-79swapBDS94-100/ SaSSY116-124swapCVS(V19)93-100/ SaSSy138-168swapCVS(V19)114-144**/ SaSSy198-207swapCVS(Vv)187-195(K206A) | 311 | 308 |
| SaSSy-18 | T192A/C195Y/S198N/E205Q/A240E/ G323A/I330M/L335H/S338Y/V346A | SaSSy116-124swapCVS(V19)93-100 | 146 | 62 |

TABLE 21

Comparative production of total terpenes, α-santalene, β-santalene and other products with the codon-optimized SaSSy in yeast

| SaSSy # | SEQ ID NO: aa | SEQ ID nuc | α-santalene % | β-santalene % | other products % | total terpene production % |
|---|---|---|---|---|---|---|
| codon optimized SaSSy | 1 | 3 | 100 | 100 | 100 | 100 |
| SaSSy-101 | 179 | 304 | 116.11 | 152.67 | 49.73 | 108 |
| SaSSy-55 | 179 | 304 | 108.24 | 142.64 | 55.98 | 110.67 |
| SaSSy-1 | 131 | 45 | 107.8 | 123.01 | 70.8 | 139.16 |
| SaSSy-48 | 172 | 92 | 110.29 | 114.99 | 80.5 | 122.58 |
| SaSSy-19 | 147 | 63 | 107.71 | 106.51 | 80.56 | 115.05 |
| SaSSy-104 | 255 | 236 | 104.73 | 111.82 | 82.44 | 126.04 |
| SaSSy-67 | 188 | 111 | 105.5 | 105.2 | 86.2 | 127.27 |
| SaSSy-14 | 142 | 58 | 104.53 | 105.03 | 89.72 | 118.29 |
| SaSSy-134 | 244 | 282 | 109.6 | 171.69 | 36.58 | 126.81 |
| SaSSy-119 | 247 | 225 | 112.27 | 138.72 | 56.59 | 110.53 |
| SaSSy-133 | 286 | 281 | 104.1 | 113.85 | 84.84 | 115.14 |
| SaSSy-135 | 309 | 306 | 110.16 | 145.69 | 48.45 | 125.97 |
| SaSSy-76 | 191 | 120 | 101.23 | 112.54 | 85.74 | 102.34 |
| SaSSy-42 | 166 | 86 | 99.08 | 106.95 | 95.92 | 121.64 |
| SaSSy-86 | n/a | n/a | 100.78 | 106.74 | 93.53 | 116.19 |
| SaSSy-37 | 288 | 287 | 101.28 | 105.74 | 93.63 | 130.32 |
| SaSSy-96 | 250 | 228 | 99.63 | 105.27 | 96.88 | 124.48 |
| SaSSy-13 | 141 | 57 | 101.92 | 104.55 | 93.71 | 133.21 |
| SaSSy-136 | 310 | 307 | 101.55 | 134.73 | 55.57 | 144.92 |
| SaSSy-137 | 311 | 308 | 101.91 | 134.5 | 55.37 | 141.61 |
| SaSSy-18 | 146 | 62 | 112.67 | 102.83 | 75.86 | 119.46 |

Amino acid replacements shared among many of these variant, including SaSSy-134, SaSSy-135, SaSSy-136 and SaSSy-137 include: K85Q/F101L/Y176F/T192A/C195Y/ A240E/G323A/S329H/I330M/V346A/K350R/N 353D/ V433I/H446R/I465M/V502I.

Mutations shared among modified synthases, such as SaSSy-135, SaSSy-136 and SaSSy-137, include replacements at positions corresponding to N183, K206, F282. Modified santalene synthases containing the amino acid replacement F282W exhibit altered product profile, particularly relatively increased production of the santalenes. Modified synthases that contain K206G/F282W, such as SaSSy-135, catalyze increased production of terpenes and altered product profile. The combination of K206, such as K206G or K206T, with F282W, or with F282W and N183K catalyze increased production of terpenes, and alter the product profile to produce more α- and/or β-santalene.

Domain swaps shared, for example, among SaSSy-134, SaSSy-135, SaSSy-136 and SaSSy-137, include:

SaSSy73-79swapBDS94-100/

SaSSY116-124swapCVS(V19)93-100/

SaSSy138-168swapCVS(V19)114-144**/

SaSSy198-207swapCVS(Vv)187-195 (SaSSy-135, SaSSy-136 and SaSSy-137 have additional K206 mutations within this domain swap).

Since modifications will be apparent to those of skill in the art, it is intended that this invention be limited only by the scope of the appended claims.

SEQUENCE LISTING (311 sequences)

SEQ ID NO: 1 - protein, 569 aa, Santalum album
  Santalene synthase
  ref <308>: DATABASE ACCESSION NUMBER: Genbank ADO87000
  ref <309>: DATABASE ENTRY DATE: 2011-05-17
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 2 - DNA, 1710 bp, Santalum album
  Santalene synthase
  ref <308>: DATABASE ACCESSION NUMBER: Genbank HQ343276
  ref <309>: DATABASE ENTRY DATE: 2011-05-17
atggattcttccaccgccaccgccatgacagctccattcattgatcctactgatcatgtgaatctcaaaactgatacggatgcctcagagaatcgaaggatgggaaattataaacccagcatttggaattatgattttttacaatcacttgcaactcatcacaatattgtggaagagaggcatctaaagctagctgagaagctgaagggccaagtgaagtttatgtttggggcaccaatggagccgttagcaaagctggagcttgtggatgtggttcaaaggcttgggctaaaccacctatttgagacagagatcaaggaagcgctgtttagtatttacaaggatgggagcaatggatggtggtttggccaccttcatgcgacatctctccgatttaggctgctacgacagtgtgggctttttattccccaagatgtgtttaaaacgttccaaaacaagactggggaatttgatatgaaactttgtgacaacgtaaaagggctgctgagcttatatgaagcttcatacttgggatggaagggtgaaaacatcctagatgaagccaaggccttcaccaccaagtgcttgaaaagtgcatgggaaaatatatccgaaaagtggttagccaaaagagtgaagcatgcattggctttgcctttgcattggagagtccctcgaatcgaagctagatggttcattgaggcatatgagcaagaagcgaatatgaacccaacactactcaaactcgcaaaattagactttaatatggtgcaatcaattcatcagaaagagattggggaattagcaaggtggtgggtgactactggcttggataagttagcctttgccaggaataatttactgcagagctatatgtggagctgcgcgattgcttccgacccgaagttcaaacttgctagagaaactattgtcgaaatcggaagtgtactcacagttgttgacgatggatatgacgtctatggttcaatcgacgaacttgatctctacacaagctccgttgaaaggtggagctgtgtggaaattgacaagttgccaaacacgttaaaattaatttttatgtctatgttcaacaagaccaatgaggttggccttcgagtccagcatgagcgaggctacaatagcatccctacttttatcaaagcgtgggttgaacagtgtaaatcataccagaaagaagcaagatggttccacgggggacacacgcctccattggaagaatatagcttgaatggacttgtttccataggattccctctcttgttaatcacgggctacgtggcaatcgctgagaacgaggctgcactggataaagtgcacccccttcctgatcttctgcactactcctccctccttagtcgcctcatcaatgatataggaacgtctccggatgagatggcaagaggcgataatctgaagtcaatccattgttacatgaacgaaactggggcttccgaggaagttgctcgtgagcacataaagggagtaatcgaggagaattggaaaatactgaatcagtgctgctttgatcaatctcagtttcaggagccttttataaccttcaatttgaactctgttcgagggtctcatttcttctatgaatttggggatggctttggggtgacggatagctggacaaaggttgatatgaagtccgttttgatcgaccctattcctctcggcgaggagtag

SEQ ID NO: 3 - DNA, 1710 bp, Artificial Sequence
  codon optimized Santalum album santalene synthase
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatggttctaatggttggtggtttggtcacttgcatgctacatccttgagattcagattattgagacaatgcggtttgttcatcccacaagacgttttcaagaccttccaaaacaagactggtgaattcgatatgaagttgtgcgataacgttaagggtttgttgtccttgtatgaagcttcttacttgggttggaagggtgaaaacattttggatgaagctaaggctttcactaccaagtgtttgaaatccgcttgggaaaacatttctgaaaagtggttggccaaaagagttaagcacgctttggctttgccattgcattggagagttccaagaattgaagccagatggttcattgaagcctacgaacaagaggctaacatgaacccaaccttgttgaagttggcaaagttggatttcaacatggttcaatccatccaccaaaaagaaattggtgaattggctagatggtgggttactactggtttggataagttggctttcgctagaaacaacttgttgcaatcctacatgtggtcttgtgctattgcttctgacccaaagtttaagttggccagagaaaccatagttgaaatcggttccgttttgaccgttgttgatgatggttacgatgtttacggttccatcgatgaattggacttgtacacctcttctgttgaaagatggtcctgcgttgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattccttgaacggtttggtttctattggtttccctttgttgttgattacaggttacgttgctattgctgaaaatgaagccgctttggataaggttcatccattgccagatttgttgcactactcatccttgttgtccagattgatcaacgatattggtacttctccagacgaaatggctagaggtgataacttgaagtccatccactgttacatgaacgaaactggtgcttctgaagaagttgctagagaacacatcaagggtgtcattgaagaaaactggaagatcttgaatcaatgctgcttcgatcaatcccaattccaagaaccattcatcaccttcaacttgaactctgttagaggttcccatttcttctacgaattcggtgatggttttggtgttactgattcctggaccaaggttgatatgaagtccgttttgatcgatccaattccattgggtgaagaatga

SEQ ID NO: 4 - DNA, 1710 bp, Santalum album
  Santalene bergamotene synthase 2
  ref <308>: DATABASE ACCESSION NUMBER: Genbank HQ259029
  ref <309>: DATABASE ENTRY DATE: 2010-11-06
atggattcttccaccgccaccgccatgacagctccattcattgatcctactgatcatgtgaatctcaaaactgatactgatgcctcagagaatcgaaggatgggaaattataaacccagcatttggaattatgattttttacaatcacttgcaactcatcacaatattgtggaagagaggcatctaaagctagctgagaagctgaagggccaagtgaagtttatgtttggggcaccaatggagccgttagcaaagctggagcttgtggatgtggttcaaaggcttgggctaaaccacctatttgagacagagatcaaggaagcgctgtttagtatttacaaggatgggagcaatggatggtggtttggccaccttcatgcgacatctctccgatttaggctgctacgacagtgtgggctttttattccccaagatgtgtttaaaacgttccaaaacaaaactggggaatttgatatgaaactgtgggacaacgtaaaagggctgctgagcttatatgaagcttcatacttgggatggaagggtgaaaacatcctagatgaagccaaggccttcaccaccaagtgcttgaaaagtgcatgggaaaatatatccgaaaagtggttagccaaaagagtgaagcatgcattggctttgcctttgcattggagagtccctcgaatcgaagctagatggttcattgaggtatatgagcaagaagcgaatatgaacccaacactactcaaactcgcaaaattagactttaatatggtgcaatcaattcatcagaaagagattggggaattagcaaggtggtgggtgactactggcttggataagttagactttgctaggaataatttactgcagagctatatgtggagctgcgcgattgcttccgacccgaagttcaaacttgctagagaaactattgtcgaaatcggaagtgtactcacagttgttgacgatggatatgacgtctatggttcaatggacgaacttgatctctacacaagctccgttgaaaggtggagctgtgtgaaaattgacaagttgccaaacacgttaaaattaatttttatgtctatgttcaacaagaccaatgaggttggtcttcgagtccagcatgagcgaggctacaatagcatccctacttttatcaaagcgtgggttgaacagtgtaaatcataccagaaagaagcaagatggttccacgggggacacacgcctccattggaagaatatagcttgaatggacttgtttccataggattccctctcttgttaatcacaggctacgtggcaatcgctgagaacgaggctgcactggataaagtgcacccccttcctgatcttctgcactactcctccctccttagtcgcctcatcaatgatataggaacgtctccggatgagatggcaagaggcgataatctgaagtcaatccattgttacatgaacgaaactggggcttccgaggaagttgctcgtgagcacataaagggagtaatcgaggagaattggaaaatactgaatcagtgctgctttgatcaatctcagtttcaggagccttttataaccttcaatttgaactctgttcgagggtctcatttcttctatgaatttggggatggctttggggtgacggatagctggacaaaggttgatatgaagtccgttttgatcgaccctattcctctcggcgaggagtag

SEQ ID NO: 5 - DNA, 1725 bp, Santalum album
  Santalene synthase
  ref <310>: PATENT DOCUMENT NUMBER: WO2010067309
  ref <311>: PATENT FILING DATE: 2009-12-09
  ref <312>: PUBLICATION DATE: 2010-06-17
actaatggattcttccaccgccaccgccatgacagctccattcattgatcctactgatcatgtgaatctcaaaactgatactgatgcctcagagaatcgaaggatgggaaattataaacccagcatttggaattatgattttttacaatcacttgcaactcatcacaatattgtggaagagaggcatctaaagctagctgagaagctgaagggccaagtgaagtttatgtttggggcaccaatggagccgttagcaaagctggagcttgtggatgtggttcaaaggcttgggctaaaccacctatttgagacagagatcaaggaagcgctgtttagtatttacaaggatgggagcaatggatggtggtttggccaccttcatgcgacatctctccgatttaggctgctacgacagtgtgggctttttattccccaagatgtgtttaaaacgttccaaaacaaaactggggaatttgatatgaaactgtgggacaacgtaaaagggctgctgagcttatatgaagcttcatacttgggatggaagggtgaaaacatcctagatgaagccaaggccttcaccaccaagtgcttgaaaagtgcatgggaaaatatatccgaaaagtggttagccaaaagagtgaagcatgcattggctttgcctttgcattggagagtccctcgaatcgaagctagatggttcattgaggtatatgagcaagaagcgaatatgaacccaacactactcaaactcgcaaaattagactttaatatggtgcaatcaattcatcagaaagagattggggaattagcaaggtggtgggtgactactggcttggataagttagactttgctaggaataatttactgcagagctatatgtggagctgcccgattgcttccgacccgaagttcaaacttgctagagaaactattgtcgaaatcggaagtgtactcacagttgttgacgatggatatgacgtctatggttcaatggacgaacttgatctctacacaagctccgttgaaaggtggagctgtgtgaaaattgacaagttgccaaacacgttaaaattaatttttatgtctatgttcaacaagaccaatgaggttggtcttcgagtccagcatgagcgaggctacaatagcatccctacttttatcaaagcgtgggttgaacagtgtaaatcataccagaaagaagcaagatggttccacgggggacacacgcctccattggaagaatatagcttgaatggacttgtttccataggattccctctcttgttaatcacaggctacgtggcaatcgctgagaacgaggctgcactggataaagtgcacccccttcctgatcttctgcactactcctccctccttagtcgcctcatcaatgatataggaacgtctccggatgagatggcaagaggcgataatctgaagtcaatccattgttacatgaacgaaactggggcttccgaggaagttgctcgtgagcacataaagggagtaatcgaggagaattggaaaatactgaatcagtgctgctttgatcaatctcagtttcaggagccttttataaccttcaatttgaactctgttcgagggtctcatttcttctatgaatttggggatggctttggggtgacggatagctggacaaaggttgatatgaagtccgttttgatcgaccctattcctctcggcgaggagtagtaagctcgaag

SEQ ID NO: 6 - DNA, 1710 bp, Santalum album
  santalene bergamotene synthase
  ref <310>: PATENT DOCUMENT NUMBER: WO2010067309
  ref <311>: PATENT FILING DATE: 2009-12-09
  ref <312>: PUBLICATION DATE: 2010-06-17
atggattcttccaccgccaccgccatgagagctccattcattgatcatactgatcatgtgaatctcagaactgataacgattcctcagagaatcgaaggatggggaattataaacccagtatttggaactatgattttttgcaatcgcttgcgactcgccacaatattatggaagagaggcatctaaagctagctgagaagctgaagggccaagtgaagtttatgtttggggcaccaatggagccgttagcaaagctggagcttgtggatgtggttcaaaggctcgggctaaaccaccgatttgagacagagatcaaggaagcgctatttagtatttataaggatgagagcaatggatggtggtttggccacctccatgcgacatctctccgatttaggctgctacgacagtgtgggctttttatcccccaggatgtgtttaaaacatttcagagcaaaactggtgaatttgatatgaaactgtgtgacaatgtaaaaggattgctgagcttgtatgaagcttcattcttggggtggagggatgaaaacatcttagatgaagccaaagccttcgccaccaagtacttgaaaaatgcatgggaaaacatatcccaaaagtggcttgccaaaagagtgaagcatgcactggctttgcctttgcactggagagtccctagaatcgaagctagatggttcgttgaggcatatggggaagaagagaatatgaacccaacacttctcaaacttgcaaaattggactttaacatggtgcaatcaattcatcagaaagagattggggaattagcgaggtggtgggtgactacggggttggataagttagcgtttgctaggaataatttactgcaaagctatatgtggagctgcgcgattgcttccgacccaaagttcaaacttgctagagaaactattgttgaaatcggaagtgtactcacagttgttgacgatgcatatgacgtctatggttcaatggatgaacttgatctctacacgaactccgttgaaaggtggagctgtacagaaattgacaagttaccaaacacattaaaattgatttttatggctatgtttaacaagaccaatgaagttggccttcgagtccagcatgagcgaggctacagcggcatcactacttttatcaaagcatgggttgaacagtgtaaatcgtaccagaaagaagcaagatggtaccatgggggacacacgcctccactggaagaatatagcttgaatggacttgtttccataggattccctctcttgttgatcacaggctacgtggcaatcgctgagaacgaggctgcactggataaagtgcacccccttcctgatcttctgcactactcctccctccttagtcgcctcatcaatgatatgggaacctcttcggacgagttggaaaggggagataatctgaagtcaattcaatgttacatgaaccaaactggggcttctgagaaagttgctcgtgagcacataaagggaataatcgaggaaaactggaaaatactgaatgagtgttgctttgatcaatctcagtttcaggagccttttgtaacattcaatttgaactctgttcgagggtctcatttcttctacgaatttggagatggctttggggtgacgaatagctggacaaaggttgatatgaagtctgttttgatcgatcctattcctctcgacgaggagtag

SEQ ID NO: 7 - DNA, 2157 bp, Santalum album
  santalene synthase
  ref <310>: PATENT DOCUMENT NUMBER: WO2010067309
  ref <311>: PATENT FILING DATE: 2009-12-09
  ref <312>: PUBLICATION DATE: 2010-06-17
acaaaataaatctcttgttctgttctttggatctcgttttcttcccctcagctctctcactaatggattcttccaccgccaccgccatgagagctccattcattgatcatactgatcatgtgaatctcagaactgataacgattcctcagagaatcgaaggatggggaattataaacccagtatttggaactatgattttttgcaatcgcttgcgactcgccacaatattatggaagagaggcatctaaagctagctgagaagctgaagggccaagtgaagtttatgtttggggcaccaatggagccgttagcaaagctggagcttgtggatgtggttcaaaggctcgggctaaaccaccgatttgagacagagatcaaggaagcgctatttagtatttataaggatgagagcaatggatggtggtttggccacctccatgcgacatctctccgatttaggctgctacgacagtgtgggctttttatcccccaggatgtgtttaaaacatttcagagcaaaactggtgaatttgatatgaaactgtgtgacaatgtaaaaggattgctgagcttgtatgaagcttcattcttggggtggagggatgaaaacatcttagatgaagccaaagccttcgccaccaagtacttgaaaaatgcatgggaaaacatatcccaaaagtggcttgccaaaagagtgaagcatgcactggctttgcctttgcactggagagtccctagaatcgaagctagatggttcgttgaggcatatggggaagaagagaatatgaacccaacacttctcaaacttgcaaaattggactttaacatggtgcaatcaattcatcagaaagagattggggaattagcgaggtggtgggtgactacggggttggataagttagcgtttgctaggaataatttactgcaaagctatatgtggagctgcgcgattgcttccgacccaaagttcaaacttgctagagaaactattgttgaaatcggaagtgtactcacagttgttgacgatgcatatgacgtctatggttcaatggatgaacttgatctctacacgaactccgttgaaaggtggagctgtacagaaattgacaagttaccaaacacattaaaattgatttttatgtctatgtttaacaagaccaatgaagttggccttcgagtccagcatgagcgaggctacagtggcatcactacttttatcaaagcgtgggttgaacagtgtaaatcgtaccagaaagaagcaagatggtaccatgggggacacacgcctccactggaagaatatagcttgaatggactggtttccataggattccctctcttgttgatcacaggctacgtggcaatcgctgagaacgaggctgcactggataaagtgcacccccttcctgatcttctgcactactcctccctccttagtcgcctcatcaatgatatgggaacctcttcggacgagttggaaaggggagataatctgaagtcaattcaatgttacatgaaccaaactggggcttctgagaaagttgctcgtgagcacataaagggaataatcgaggaaaactggaaaatactgaatgagtgttgctttgatcaatctcagtttcaggagccttttgtaacattcaatttgaactctgttcgagggtctcatttcttctacgaatttggagatggctttggggtgacggatagctggacaaaggttgatatgaagtctgttttgatcgatcctattcctctcgacgaggagtagaaaactcaaagcttgtgcttggtttacggtaatagtgattcagtataaatataaaaatcggacgaacttgaggaatatgtgaggcataactatttttaatgatcatgagttaaataattaagaaatatctattcggctcatgattcttgagtatatattattccttatgcgttatatttccatcaaataattagtccgctcctgtaagtcgactgtaacattactctaagggtcgctattggttttatgttatattaagtctactagtttgaagtgatggaataaatgtttgtttttaagggggttatgcactatgttctcggttgccttttactaataaattttttatgaaactcaaaaaaaaaaaaaaaaaaaaaaaaaaaaa

SEQ ID NO: 8 - DNA, 1656 bp, Artificial Sequence
  santalene synthase
  ref <310>: PATENT DOCUMENT NUMBER: WO2010067309
  ref <311>: PATENT FILING DATE: 2009-12-09
  ref <312>: PUBLICATION DATE: 2010-06-17
atggcaaccttgaagactgacaccgacgctagcgagaatcgtcgcatgggcaactataaaccgagcatttggaactacgatttcctgcaaagcctggctacccaccacaatatcgtggaggagcgtcacctgaaactggcagaaaaattgaaaggccaagtgaaattcatgttcggcgcaccgatggaaccgctggcgaaactggagctggtcgacgtggtccaacgcctgggtctgaatcacctgtttgaaaccgaaattaaagaggcactgttcagcatctataaggacggttcgaacggttggtggttcggtcacctgcatgcaaccagcctgcgttttcgtctgctgcgtcagtgtggcctgttcattccgcaggacgtctttaaaacctttcagaacaaaaccggcgagtttgacatgaagctgtgggacaatgtgaaaggcctgttgagcctgtatgaggcgagctacctgggttggaagggtgaaaacatcctggatgaagcaaaggcatttaccaccaagtgtctgaagagcgcgtgggaaaatatctctgagaaatggttggcgaaacgtgtgaagcacgcgctggcgctgccgctgcactggcgcgttccgcgcatcgaagcgcgctggtttatcgaagtttatgaacaggaagctaatatgaacccgaccctgctgaagctggcgaagctggatttcaacatggttcaaagcattcatcaaaaggagatcggcgagctggcccgctggtgggtgaccacgggtttggacaagctggactttgcacgtaataatctgttgcaaagctacatgtggagctgcgctatcgcatccgacccgaaatttaagttggcacgtgaaaccatcgttgaaattggtagcgtgctgactgtggtggatgacggttacgatgtttacggtagcatggacgaactggacctgtacacgtcgagcgtcgagcgctggagctgtgtcaaaattgataagctgccgaacacgctgaaactgatcttcatgagcatgttcaacaaaaccaacgaagtgggcctgcgcgtgcagcacgaacgtggctataatagcattccgacgtttatcaaggcatgggtggagcaatgtaaaagctaccaaaaagaggcccgttggtttcatggcggccataccccgcctctggaggaatatagcctgaacggcctggtgtccattggttttccgctgctgctgatcaccggctacgtggcaatcgcggaaaatgaagccgcgctggacaaggtccatccactgccggacctgttgcattatagctctctgctgagccgtctgatcaatgatatcggtacgagcccggacgagatggctcgtggtgacaacctgaaaagcatccattgttatatgaacgagacgggtgcgtccgaagaggtcgcccgcgagcatatcaagggcgttattgaggagaactggaaaatcctgaatcaatgttgcttcgatcaaagccagttccaagagccgttcatcacgttcaatctgaacagcgttcgcggtagccactttttctacgaatttggcgacggttttggcgttacggacagctggaccaaagttgatatgaaatccgttctgatcgacccgatcccgttgggtgaagagtag

SEQ ID NO: 9 - DNA, 1650 bp, Artificial Sequence
  santalene synthase
  ref <310>: PATENT DOCUMENT NUMBER: WO2010067309
  ref <311>: PATENT FILING DATE: 2009-12-09
  ref <312>: PUBLICATION DATE: 2010-06-17
atggctaccgataatgacagctctgaaaaccgtcgtatgggtaattacaagccgtccatctggaactacgacttcctgcagtccctggctacccgccacaatatcatggaagagcgccacttgaaactggcggagaaactgaaaggccaggtgaagtttatgtttggtgccccgatggagccgctggccaaactggagctggttgatgttgttcagcgcctgggtctgaatcatcgcttcgagacggagattaaggaggccctgttcagcatctacaaggatgagagcaacggttggtggtttggccacctgcatgccaccagcctgcgttttcgcctgctgcgccagtgtggtctgttcattccgcaagacgttttcaagacgttccaaagcaagaccggcgagttcgacatgaaactgtgcgacaacgtcaagggtttgctgagcctgtacgaggcttcctttctgggctggcgtgacgaaaatatcctggacgaagcgaaagcttttgccacgaagtacctgaagaacgcatgggaaaacattagccagaagtggctggcgaaacgcgtgaagcatgcgttggcactgccgttgcactggcgtgtgcctcgtattgaagcacgctggtttgttgaggcgtacggcgaggaggaaaatatgaatccgaccttgctgaagctggctaagttggattttaacatggtgcaatctattcaccaaaaggaaatcggtgaattggcacgttggtgggtcaccaccggtctggacaaactggcattcgcgcgcaataatttgctgcaaagctacatgtggagctgcgcgatcgcatctgacccgaagtttaagctggctcgcgaaaccatcgtggagatcggttccgtgctgactgttgtggatgacgcctacgatgtttacggtagcatggacgaactggacttgtataccaatagcgtggagcgttggagctgtacggaaatcgataagctgccgaatacgctgaaactgatttttatggctatgtttaacaagaccaatgaagttggtctgcgtgttcagcacgagcgtggttactccggcatcaccaccttcattaaggcatgggtcgaacagtgtaagagctatcaaaaagaagcgcgctggtatcatggtggtcacacgcctccgctggaagagtactccttgaatggcttggtgagcattggtttcccgctgctgctgattaccggctacgtcgccattgccgaaaacgaagcagcgctggacaaagtgcatccgctgccggatctgctgcactatagctctctgctgagccgcctgatcaacgacatgggtacgagcagcgacgagctggagcgcggcgataatctgaaaagcatccaatgctatatgaatcagaccggcgcgagcgagaaggtggcgcgcgagcacatcaagggcatcattgaggagaattggaagattctgaacgaatgttgcttcgaccaaagccaatttcaagagccgttcgtgacgttcaacctgaacagcgttcgtggttcccatttcttttacgagtttggtgacggtttcggtgtgacgaatagctggaccaaggttgacatgaagagcgtcctgattgatccgattccactggatgaagaataatga

SEQ ID NO: 10 - protein, 569 aa, Santalum spicatum
  Santalene synthase
  ref <308>: DATABASE ACCESSION NUMBER: Genbank ADO87002
  ref <309>: DATABASE ENTRY DATE: 2011-05-17
MDSSTATATTAPFIDHTDHVNLKIDNDSSESRRMGNYKPSIWNYDFLQSLAIHHNIVEEKHLKLAEKLKGQVMSMFGAPMEPLAKLELVDVVQRLGLNHQFETEIKEALFSVYKDGSNGWWFGHLHATSLRFRLLRQCGLFIPQDVFKTFQSKTDEFDMKLCDNIKGLLSLYEASFLGWKGENILDEAKAFATKYLKNAWENISQKWLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGSMDELDHYTYSVERWSCVEIDKLPNTLKLIFMSMFNKTNEVGLRVQHERGYNGIPTFIKAWVEQCKAYQKEARWYHGGHTPPLEEYSLNGLVSIGFPLLLITGYIAIAENEAALDKVHPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 11 - DNA, 1710 bp, Santalum spicatum
  Santalene synthase
  ref <308>: DATABASE ACCESSION NUMBER: Genbank HQ343278
  ref <309>: DATABASE ENTRY DATE: 2011-05-17
atggattcttccaccgccaccgccacgacagctccatttattgatcatactgatcatgtgaatcttaaaattgataatgattcctccgagagtcgaaggatgggcaattataaacccagtatttggaattatgattttctgcaatcacttgcaatccatcacaatattgtggaagagaagcatctaaagctagctgagaagctgaagggccaagtgatgtctatgtttggggcaccaatggagccgttagcaaagctggagcttgtggatgtggttcaaaggcttgggctaaaccaccaatttgagacagagatcaaggaagccctatttagtgtttacaaggatgggagcaatggatggtggtttggccaccttcatgcaacatctcttcgatttaggctactacgacagtgtgggctttttatcccccaggatgtgtttaaaacgttccagagcaaaactgatgaatttgatatgaaactgtgtgacaacataaaagggttgttgagcttgtatgaagcttcattcctggggtggaagggtgaaaacatcctagatgaagccaaggccttcgccaccaagtacttgaaaaatgcatgggaaaatatatcccaaaagtggctagccaaaagagtgaagcatgcactggctttgcctctgcactggagagtccctcgaatcgaggctagatggttcattgaggcatatgagcaagaagagaacatgaacccaacactactcaaacttgcaaaattagactttaacatggtgcaatcaattcatcagaaagagattggggaattagcaaggtggtgggtgactactggcttggataagttagcctttgctaggaataatttactgcaaagctatatgtggagctgcgcgattgcttccgacccaaagttcaaacttgctagagaaactattgtcgaaatcggaagtgtactcacagttgtggacgatgcatatgatgtctatggttcaatggatgaacttgatcactacacatactccgttgaaaggtggagctgtgtagaaattgacaagctgccaaacacgttaaaattgatttttatgtctatgttcaacaagaccaatgaggttggccttcgagtccagcatgagcgaggctacaacggcatccctacttttatcaaagcatgggttgaacagtgtaaagcataccagaaagaggcaagatggtaccatgggggacacacgcctccattggaggaatatagcttgaatggacttgtttccataggattccctctcttgttgatcaccggctacatcgcaatcgctgagaacgaggctgcactggataaagtgcacccccttcctgatcttctgcactactcctccctccttagtcgcctcatcaatgacatgggaacgtctccggacgagatggcaagaggtgacaatctgaagtcaatccactgttacatgaacgaaactggggcttctgaggaagttgctcgtgagcacataaaaggaataatcgaggagaattggaaaatactgaatcagtgctgctttgatcaatctcagtttcaggagccttttataaccttcaatttgaactctgttcgagggtctcatttcttctatgaatttggggatggctttggggtgacagatagctggacaaaggttgatatgaagtctgttttgatcgaccctattcctctcggcgaggagtag

SEQ ID NO: 12 - protein, 569 aa, Santalum austrocaledonicum
  Santalene synthase
  ref <308>: DATABASE ACCESSION NUMBER: Genbank ADO87001
  ref <309>: DATABASE ENTRY DATE: 2011-05-17
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHRFETEIKEALFSIYKDESNGWWFGHLHATSLRFRLLRQCGLFIPQDVFKTFQNKTGEFDMKLCDNVKGLLSLYEASYLGWKGENILDEAKAFATKYLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDAYDVYGSMDELDLYTSSVERWSCVEIDKLPNTLKLIFMSMFNKTNEVGLRVQHERGYNSIPTFIKAWVQQCKSYQKEARWFHGGHTPPLEEYSLNGLVSIGFPLLLITGYVAIAENEAALDKVHPLPDLLHYSSLLSRLINDIGTSPDEMARGDNLKSIHCYMNGTGASEEVAREHIKGVIEENWKILNQCCFDQSQFQEPFITFNLNSVRGSHFFYEFGDGFGVTDSWTKVDMKSVLIDPIPLGEE

SEQ ID NO: 13 - DNA, 1713 bp, Santalum austrocaledonicum
  Santalene synthase
  ref <308>: DATABASE ACCESSION NUMBER: Genbank HQ343277
  ref <309>: DATABASE ENTRY DATE: 2011-05-17
atggattcttccaccgccaccgccatgacagctccattcattgatcctactgatcatgtgaatctcaaaactgatactgatgcctcagagaatcgaaggatggggaattataaacccagcatttggaattatgattttttacaatcacttgcaactcatcacaatattgtggaagagaggcatctaaagctagctgagaagctgaagggccaagtgaagtttatgtttggggcaccaatggagccgttagcaaagctggagcttgtggatgtggttcaaaggctcgggctaaaccaccgatttgagacagagatcaaggaagcgctatttagtatttataaggacgagagcaatggatggtggtttggccaccttcatgcgacatctctccgatttaggctgctacgacagtgtgggctttttatcccccaggatgtgtttaaaacgttccaaaacaaaactggtgaatttgatatgaaactgtgtgacaacgtaaaagggctgctgagcttatatgaagcttcatacttgggatggaagggtgaaaacatcctagatgaagccaaggccttcgccaccaagtacttgaaaagtgcatgggaaaatatatctgaaaagtggttagccaaaagagtgaagcatgcattggctttacctttgcattggagagtccctcgaatcgaagctagatggttcattgaggcatatgagcaagaagcgaatatgaacccaacactactcaaactcgcaaaattagactttaatatggtgcaatcaattcatcagaaagagattggggaattagcaaggtggtgggtgactactggcttggataagttagcctttgctaggaataatttactgcaaagctatatgtggagctgcgcgattgcttccgacccgaagttcaaacttgctagagaaactattgtcgaaatcggaagtgtactcacagttgttgatgatgcatatgacgtctatggttcaatggacgaacttgatctctacacaagctccgttgaaaggtggagctgtgtagaaattgacaagttgccaaacacgttaaaattgatttttatgtctatgtttaataagaccaatgaggttggccttcgagtccagcatgagcgaggctacaatagcatccctacttttatcaaagcgtgggttcaacagtgtaaatcataccagaaagaagcaagatggttccacgggggacacacgcctccgttggaagaatatagcttgaatggacttgtttccataggattccctctcttgttgatcaccggctacgtggcaatcgctgagaacgaggctgcactggataaagtgcacccccttcctgatcttctgcactactcctccctccttagtcgcctcatcaatgatataggaacgtctccggatgagatggcaagaggcgataatctgaagtcaatccattgttacatgaacggaactggggcttccgaggaagttgctcgtgagcacataaagggagtaatcgaggagaattggaaaatactgaatcagtgctgctttgatcaatctcagtttcaggagccttttataaccttcaatttgaactctgttcgagggtctcatttcttctatgaatttggggatggctttggggtgacggatagctggacaaaggttgatatgaagtccgttttgattgaccctattcctctcggcgaggagtagtaa

SEQ ID NO: 14 - protein, 569 aa, Santalum murrayanum
  Santalene synthase
  ref <308>: DATABASE ACCESSION NUMBER: Uniprot F6M8H8
  ref <309>: DATABASE ENTRY DATE: 2011-07-27
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEVLFSIYKDGSNGWWFDHLHATSLRFRLLRQCGLFIPQDVFKMFQNKTGELDMKLCDNVKGLLSLYEASYLGWKGENILDEAKAFATKYLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDAYDVYGSMDELDLYTSSVERWSCVEIDKLPNTLKLIFMSMFNKTNEVGLRVQHERGYNSIPTFIKAWVQQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 15 - DNA, 1710 bp, Santalum murrayanum
  Santalene synthase
  ref <308>: DATABASE ACCESSION NUMBER: AEF32533
  ref <309>: DATABASE ENTRY DATE: 2011-05-23
atggattcttccaccgccaccgccatgacagctccattcattgatcctactgatcatgtgaatctcaaaactgataccgatgcctcagagaatcgaaggatggggaattataaacccagcatttggaactatgattttttacaatcacttgcaactcatcacaatattgtggaagagaggcatctaaagctagctgagaagctgaagggccaagtgaagtttatgtttggggcaccaatggagccgttagcaaagctggagcttgtggatgtggttcaaaggcttgggctaaaccacctatttgagacagagatcaaggaagtgctatttagtatttacaaggatgggagcaatggatggtggtttgaccaccttcatgcgacatctctccgatttaggctgctacgacagtgtgggctttttattccccaagatgtgtttaaaatgttccaaaacaaaactggtgaacttgatatgaaactgtgtgacaacgtaaaagggctgctgagcttatatgaagcttcatacttgggatggaagggtgaaaacatcctagatgaagccaaggccttcgccaccaagtacttgaaaagtgcgtgggaaaatatatctgaaaagtggttagccaaaagagtgaagcatgcattggctttgcctttgcattggagagtccctcgaatcgaagctagatggttcattgaggcatatgagcaagaagcgaatatgaacccaacactactcaaactcgcaaaattagactttaatatggtgcaatcaattcatcagaaagagattggagaattagcaaggtggtgggtgactactggcttggataagttagcctttgctaggaataatttactgcagagctatatgtggagctgcgcgattgcttccgacccgaagttcaaacttgctagagaaactattgtcgaaatcggaagtgtactcacagttgttgatgatgcatatgacgtctatggttcaatggacgaacttgatctttacacaagctccgttgaaaggtggagctgtgtagaaattgacaagttgccaaacacgttaaaattgatttttatgtctatgttcaacaagaccaatgaggttggccttcgagtccagcatgagcgaggctacaatagcatccctacttttatcaaagcgtgggttcaacagtgtaaatcataccagaaagaagcaagatggttccacgggggacacacgcctccgttggaagaatatagcttgaatggacttgtttccataggattccctctcttgttgatcaccggctacgtggcaatcgctgagaacgaggctgcactggataaagtgcacccccttcctgatcttctgcactactcttccctccttagtcgcctcatcaatgatataggaacgtctccggatgagatggcaagaggcgataatctgaagtcaatccattgttacatgaacgaaactggggcttccgaggaagttgctcgtgagcacataaagggagtaatcgaggagaattggaaaatactgaatcagtgctgctttgatcaatctcagtttcaggagccttttataaccttcaatttgaactctgttcgagggtctcatttcttctatgaatttggggatggctttggggtgacggatagctggacaaaggttgatatgaagtccgttttgatcgaccctattcctctcggcgaggagtag

SEQ ID NO: 16 - DNA, 1710 bp, Artificial Sequence
  Santalene synthase Y539F
  ref <308>: DATABASE ACCESSION NUMBER: Genbank JQ690658
  ref <309>: DATABASE ENTRY DATE: 2013-05-11
atggattcttccaccgccaccgccatgacagctccattcattgatcctactgatcatgtgaatctcaaaactgatacggatgcctcagagaatcgaaggatgggaaattataaacccagcatttggaattatgattttttacaatcacttgcaactcatcacaatattgtggaagagaggcatctaaagctagctgagaagctgaagggccaagtgaagtttatgtttggggcaccaatggagccgttagcaaagctggagcttgtggatgtggttcaaaggcttgggctaaaccacctatttgagacagagatcaaggaagcgctgtttagtatttacaaggatgggagcaatggatggtggtttggccaccttcatgcgacatctctccgatttaggctgctacgacagtgtgggctttttattccccaagatgtgtttaaaacgttccaaaacaagactggggaatttgatatgaaactttgtgacaacgtaaaagggctgctgagcttatatgaagcttcatacttgggatggaagggtgaaaacatcctagatgaagccaaggccttcaccaccaagtgcttgaaaagtgcatgggaaaatatatccgaaaagtggttagccaaaagagtgaagcatgcattggctttgcctttgcattggagagtccctcgaatcgaagctagatggttcattgaggcatatgagcaagaagcgaatatgaacccaacactactcaaactcgcaaaattagactttaatatggtgcaatcaattcatcagaaagagattggggaattagcaaggtggtgggtgactactggcttggataagttagcctttgccaggaataatttactgcagagctatatgtggagctgcgcgattgcttccgacccgaagttcaaacttgctagagaaactattgtcgaaatcggaagtgtactcacagttgttgacgatggatatgacgtctatggttcaatcgacgaacttgatctctacacaagctccgttgaaaggtggagctgtgtggaaattgacaagttgccaaacacgttaaaattaatttttatgtctatgttcaacaagaccaatgaggttggccttcgagtccagcatgagcgaggctacaatagcatccctacttttatcaaagcgtgggttgaacagtgtaaatcataccagaaagaagcaagatggttccacgggggacacacgcctccattggaagaatatagcttgaatggacttgtttccataggattccctctcttgttaatcacgggctacgtggcaatcgctgagaacgaggctgcactggataaagtgcacccccttcctgatcttctgcactactcctccctccttagtcgcctcatcaatgatataggaacgtctccggatgagatggcaagaggcgataatctgaagtcaatccattgttacatgaacgaaactggggcttccgaggaagttgctcgtgagcacataaagggagtaatcgaggagaattggaaaatactgaatcagtgctgctttgatcaatctcagtttcaggagccttttataaccttcaatttgaactctgttcgagggtctcatttcttctttgaatttggggatggctttggggtgacggatagctggacaaaggttgatatgaagtccgttttgatcgaccctattcctctcggcgaggagtag

SEQ ID NO: 17 - DNA, 1710 bp, Artificial Sequence
  Santalene synthase Y324F
  ref <308>: DATABASE ACCESSION NUMBER: Genbank JQ690656
  ref <309>: DATABASE ENTRY DATE: 2013-05-11
atggattcttccaccgccaccgccatgacagctccattcattgatcctactgatcatgtgaatctcaaaactgatacggatgcctcagagaatcgaaggatgggaaattataaacccagcatttggaattatgattttttacaatcacttgcaactcatcacaatattgtggaagagaggcatctaaagctagctgagaagctgaagggccaagtgaagtttatgtttggggcaccaatggagccgttagcaaagctggagcttgtggatgtggttcaaaggcttgggctaaaccacctatttgagacagagatcaaggaagcgctgtttagtatttacaaggatgggagcaatggatggtggtttggccaccttcatgcgacatctctccgatttaggctgctacgacagtgtgggctttttattccccaagatgtgtttaaaacgttccaaaacaagactggggaatttgatatgaaactttgtgacaacgtaaaagggctgctgagcttatatgaagcttcatacttgggatggaagggtgaaaacatcctagatgaagccaaggccttcaccaccaagtgcttgaaaagtgcatgggaaaatatatccgaaaagtggttagccaaaagagtgaagcatgcattggctttgcctttgcattggagagtccctcgaatcgaagctagatggttcattgaggcatatgagcaagaagcgaatatgaacccaacactactcaaactcgcaaaattagactttaatatggtgcaatcaattcatcagaaagagattggggaattagcaaggtggtgggtgactactggcttggataagttagcctttgccaggaataatttactgcagagctatatgtggagctgcgcgattgcttccgacccgaagttcaaacttgctagagaaactattgtcgaaatcggaagtgtactcacagttgttgacgatggatttgacgtctatggttcaatcgacgaacttgatctctacacaagctccgttgaaaggtggagctgtgtggaaattgacaagttgccaaacacgttaaaattaatttttatgtctatgttcaacaagaccaatgaggttggccttcgagtccagcatgagcgaggctacaatagcatccctacttttatcaaagcgtgggttgaacagtgtaaatcataccagaaagaagcaagatggttccacgggggacacacgcctccattggaagaatatagcttgaatggacttgtttccataggattccctctcttgttaatcacgggctacgtggcaatcgctgagaacgaggctgcactggataaagtgcacccccttcctgatcttctgcactactcctccctccttagtcgcctcatcaatgatataggaacgtctccggatgagatggcaagaggcgataatctgaagtcaatccattgttacatgaacgaaactggggcttccgaggaagttgctcgtgagcacataaagggagtaatcgaggagaattggaaaatactgaatcagtgctgctttgatcaatctcagtttcaggagccttttataaccttcaatttgaactctgttcgagggtctcatttcttctatgaatttggggatggctttggggtgacggatagctggacaaaggttgatatgaagtccgttttgatcgaccctattcctctcggcgaggagtag

SEQ ID NO: 18 - DNA, 1710 bp, Artificial Sequence
  Santalene synthase T318A
  ref <308>: DATABASE ACCESSION NUMBER: Genbank JQ690657
  ref <309>: DATABASE ENTRY DATE: 2013-05-11
atggattcttccaccgccaccgccatgacagctccattcattgatcctactgatcatgtgaatctcaaaactgatacggatgcctcagagaatcgaaggatgggaaattataaacccagcatttggaattatgattttttacaatcacttgcaactcatcacaatattgtggaagagaggcatctaaagctagctgagaagctgaagggccaagtgaagtttatgtttggggcaccaatggagccgttagcaaagctggagcttgtggatgtggttcaaaggcttgggctaaaccacctatttgagacagagatcaaggaagcgctgtttagtatttacaaggatgggagcaatggatggtggtttggccaccttcatgcgacatctctccgatttaggctgctacgacagtgtgggctttttattccccaagatgtgtttaaaacgttccaaaacaagactggggaatttgatatgaaactttgtgacaacgtaaaagggctgctgagcttatatgaagcttcatacttgggatggaagggtgaaaacatcctagatgaagccaaggccttcaccaccaagtgcttgaaaagtgcatgggaaaatatatccgaaaagtggttagccaaaagagtgaagcatgcattggctttgcctttgcattggagagtccctcgaatcgaagctagatggttcattgaggcatatgagcaagaagcgaatatgaacccaacactactcaaactcgcaaaattagactttaatatggtgcaatcaattcatcagaaagagattggggaattagcaaggtggtgggtgactactggcttggataagttagcctttgccaggaataatttactgcagagctatatgtggagctgcgcgattgcttccgacccgaagttcaaacttgctagagaaactattgtcgaaatcggaagtgtactcgcagttgttgacgatggatatgacgtctatggttcaatcgacgaacttgatctctacacaagctccgttgaaaggtggagctgtgtggaaattgacaagttgccaaacacgttaaaattaatttttatgtctatgttcaacaagaccaatgaggttggccttcgagtccagcatgagcgaggctacaatagcatccctacttttatcaaagcgtgggttgaacagtgtaaatcataccagaaagaagcaagatggttccacgggggacacacgcctccattggaagaatatagcttgaatggacttgtttccataggattccctctcttgttaatcacgggctacgtggcaatcgctgagaacgaggctgcactggataaagtgcacccccttcctgatcttctgcactactcctccctccttagtcgcctcatcaatgatataggaacgtctccggatgagatggcaagaggcgataatctgaagtcaatccattgttacatgaacgaaactggggcttccgaggaagttgctcgtgagcacataaagggagtaatcgaggagaattggaaaatactgaatcagtgctgctttgatcaatctcagtttcaggagccttttataaccttcaatttgaactctgttcgagggtctcatttcttctatgaatttggggatggctttggggtgacggatagctggacaaaggttgatatgaagtccgttttgatcgaccctattcctctcggcgaggagtag

SEQ ID NO: 19 - DNA, 1710 bp, Artificial Sequence
  Santalene synthase I422A
  ref <308>: DATABASE ACCESSION NUMBER: Genbank JX046552
  ref <309>: DATABASE ENTRY DATE: 2012-07-31
atggattcttccaccgccaccgccatgacagctccattcattgatcctactgatcatgtgaatctcaaaactgatacggatgcctcagagaatcgaaggatgggaaattataaacccagcatttggaattatgattttttacaatcacttgcaactcatcacaatattgtggaagagaggcatctaaagctagctgagaagctgaagggccaagtgaagtttatgtttggggcaccaatggagccgttagcaaagctggagcttgtggatgtggttcaaaggcttgggctaaaccacctatttgagacagagatcaaggaagcgctgtttagtatttacaaggatgggagcaatggatggtggtttggccaccttcatgcgacatctctccgatttaggctgctacgacagtgtgggctttttattccccaagatgtgtttaaaacgttccaaaacaagactggggaatttgatatgaaactttgtgacaacgtaaaagggctgctgagcttatatgaagcttcatacttgggatggaagggtgaaaacatcctagatgaagccaaggccttcaccaccaagtgcttgaaaagtgcatgggaaaatatatccgaaaagtggttagccaaaagagtgaagcatgcattggctttgcctttgcattggagagtccctcgaatcgaagctagatggttcattgaggcatatgagcaagaagcgaatatgaacccaacactactcaaactcgcaaaattagactttaatatggtgcaatcaattcatcagaaagagattggggaattagcaaggtggtgggtgactactggcttggataagttagcctttgccaggaataatttactgcagagctatatgtggagctgcgcgattgcttccgacccgaagttcaaacttgctagagaaactattgtcgaaatcggaagtgtactcacagttgttgacgatggatatgacgtctatggttcaatcgacgaacttgatctctacacaagctccgttgaaaggtggagctgtgtggaaattgacaagttgccaaacacgttaaaattaatttttatgtctatgttcaacaagaccaatgaggttggccttcgagtccagcatgagcgaggctacaatagcatccctacttttatcaaagcgtgggttgaacagtgtaaatcataccagaaagaagcaagatggttccacgggggacacacgcctccattggaagaatatagcttgaatggacttgtttccgcaggattccctctcttgttaatcacgggctacgtggcaatcgctgagaacgaggctgcactggataaagtgcacccccttcctgatcttctgcactactcctccctccttagtcgcctcatcaatgatataggaacgtctccggatgagatggcaagaggcgataatctgaagtcaatccattgttacatgaacgaaactggggcttccgaggaagttgctcgtgagcacataaagggagtaatcgaggagaattggaaaatactgaatcagtgctgctttgatcaatctcagtttcaggagccttttataaccttcaatttgaactctgttcgagggtctcatttcttctatgaatttggggatggctttggggtgacggatagctggacaaaggttgatatgaagtccgttttgatcgaccctattcctctcggcgaggagtag

SEQ ID NO: 20 - DNA, 1710 bp, Artificial Sequence
  Santalene synthase R284M
  ref <308>: DATABASE ACCESSION NUMBER: Genbank JX046550
  ref <309>: DATABASE ENTRY DATE: 2013-05-11
atggattcttccaccgccaccgccatgacagctccattcattgatcctactgatcatgtgaatctcaaaactgatacggatgcctcagagaatcgaaggatgggaaattataaacccagcatttggaattatgattttttacaatcacttgcaactcatcacaatattgtggaagagaggcatctaaagctagctgagaagctgaagggccaagtgaagtttatgtttggggcaccaatggagccgttagcaaagctggagcttgtggatgtggttcaaaggcttgggctaaaccacctatttgagacagagatcaaggaagcgctgtttagtatttacaaggatgggagcaatggatggtggtttggccaccttcatgcgacatctctccgatttaggctgctacgacagtgtgggctttttattccccaagatgtgtttaaaacgttccaaaacaagactggggaatttgatatgaaactttgtgacaacgtaaaagggctgctgagcttatatgaagcttcatacttgggatggaagggtgaaaacatcctagatgaagccaaggccttcaccaccaagtgcttgaaaagtgcatgggaaaatatatccgaaaagtggttagccaaaagagtgaagcatgcattggctttgcctttgcattggagagtccctcgaatcgaagctagatggttcattgaggcatatgagcaagaagcgaatatgaacccaacactactcaaactcgcaaaattagactttaatatggtgcaatcaattcatcagaaagagattggggaattagcaaggtggtgggtgactactggcttggataagttagcctttgccatgaataatttactgcagagctatatgtggagctgcgcgattgcttccgacccgaagttcaaacttgctagagaaactattgtcgaaatcggaagtgtactcacagttgttgacgatggatatgacgtctatggttcaatcgacgaacttgatctctacacaagctccgttgaaaggtggagctgtgtggaaattgacaagttgccaaacacgttaaaattaatttttatgtctatgttcaacaagaccaatgaggttggccttcgagtccagcatgagcgaggctacaatagcatccctacttttatcaaagcgtgggttgaacagtgtaaatcataccagaaagaagcaagatggttccacgggggacacacgcctccattggaagaatatagcttgaatggacttgtttccataggattccctctcttgttaatcacgggctacgtggcaatcgctgagaacgaggctgcactggataaagtgcacccccttcctgatcttctgcactactcctccctccttagtcgcctcatcaatgatataggaacgtctccggatgagatggcaagaggcgataatctgaagtcaatccattgttacatgaacgaaactggggcttccgaggaagttgctcgtgagcacataaagggagtaatcgaggagaattggaaaatactgaatcagtgctgctttgatcaatctcagtttcaggagccttttataaccttcaatttgaactctgttcgagggtctcatttcttctatgaatttggggatggctttggggtgacggatagctggacaaaggttgatatgaagtccgttttgatcgaccctattcctctcggcgaggagtag

SEQ ID NO: 21 - DNA, 1710 bp, Artificial Sequence
  Santalene synthase R474L
  ref <308>: DATABASE ACCESSION NUMBER: Genbank JX046549
  ref <309>: DATABASE ENTRY DATE: 2013-05-11
atggattcttccaccgccaccgccatgacagctccattcattgatcctactgatcatgtgaatctcaaaactgatacggatgcctcagagaatcgaaggatgggaaattataaacccagcatttggaattatgattttttacaatcacttgcaactcatcacaatattgtggaagagaggcatctaaagctagctgagaagctgaagggccaagtgaagtttatgtttggggcaccaatggagccgttagcaaagctggagcttgtggatgtggttcaaaggcttgggctaaaccacctatttgagacagagatcaaggaagcgctgtttagtatttacaaggatgggagcaatggatggtggtttggccaccttcatgcgacatctctccgatttaggctgctacgacagtgtgggctttttattccccaagatgtgtttaaaacgttccaaaacaagactggggaatttgatatgaaactttgtgacaacgtaaaagggctgctgagcttatatgaagcttcatacttgggatggaagggtgaaaacatcctagatgaagccaaggccttcaccaccaagtgcttgaaaagtgcatgggaaaatatatccgaaaagtggttagccaaaagagtgaagcatgcattggctttgcctttgcattggagagtccctcgaatcgaagctagatggttcattgaggcatatgagcaagaagcgaatatgaacccaacactactcaaactcgcaaaattagactttaatatggtgcaatcaattcatcagaaagagattggggaattagcaaggtggtgggtgactactggcttggataagttagcctttgccaggaataatttactgcagagctatatgtggagctgcgcgattgcttccgacccgaagttcaaacttgctagagaaactattgtcgaaatcggaagtgtactcacagttgttgacgatggatatgacgtctatggttcaatcgacgaacttgatctctacacaagctccgttgaaaggtggagctgtgtggaaattgacaagttgccaaacacgttaaaattaatttttatgtctatgttcaacaagaccaatgaggttggccttcgagtccagcatgagcgaggctacaatagcatccctacttttatcaaagcgtgggttgaacagtgtaaatcataccagaaagaagcaagatggttccacgggggacacacgcctccattggaagaatatagcttgaatggacttgtttccataggattccctctcttgttaatcacgggctacgtggcaatcgctgagaacgaggctgcactggataaagtgcacccccttcctgatcttctgcactactcctccctccttagtcgcctcatcaatgatataggaacgtctccggatgagatggcactaggcgataatctgaagtcaatccattgttacatgaacgaaactggggcttccgaggaagttgctcgtgagcacataaagggagtaatcgaggagaattggaaaatactgaatcagtgctgctttgatcaatctcagtttcaggagccttttataaccttcaatttgaactctgttcgagggtctcatttcttctatgaatttggggatggctttggggtgacggatagctggacaaaggttgatatgaagtccgttttgatcgaccctattcctctcggcgaggagtag

SEQ ID NO: 22 - DNA, 1710 bp, Artificial Sequence
  Santalene synthase R474M
  ref <308>: DATABASE ACCESSION NUMBER: Genbank JX046548
  ref <309>: DATABASE ENTRY DATE: 2012-07-31
atggattcttccaccgccaccgccatgacagctccattcattgatcctactgatcatgtgaatctcaaaactgatacggatgcctcagagaatcgaaggatgggaaattataaacccagcatttggaattatgattttttacaatcacttgcaactcatcacaatattgtggaagagaggcatctaaagctagctgagaagctgaagggccaagtgaagtttatgtttggggcaccaatggagccgttagcaaagctggagcttgtggatgtggttcaaaggcttgggctaaaccacctatttgagacagagatcaaggaagcgctgtttagtatttacaaggatgggagcaatggatggtggtttggccaccttcatgcgacatctctccgatttaggctgctacgacagtgtgggctttttattccccaagatgtgtttaaaacgttccaaaacaagactggggaatttgatatgaaactttgtgacaacgtaaaagggctgctgagcttatatgaagcttcatacttgggatggaagggtgaaaacatcctagatgaagccaaggccttcaccaccaagtgcttgaaaagtgcatgggaaaatatatccgaaaagtggttagccaaaagagtgaagcatgcattggctttgcctttgcattggagagtccctcgaatcgaagctagatggttcattgaggcatatgagcaagaagcgaatatgaacccaacactactcaaactcgcaaaattagactttaatatggtgcaatcaattcatcagaaagagattggggaattagcaaggtggtgggtgactactggcttggataagttagcctttgccaggaataatttactgcagagctatatgtggagctgcgcgattgcttccgacccgaagttcaaacttgctagagaaactattgtcgaaatcggaagtgtactcacagttgttgacgatggatatgacgtctatggttcaatcgacgaacttgatctctacacaagctccgttgaaaggtggagctgtgtggaaattgacaagttgccaaacacgttaaaattaatttttatgtctatgttcaacaagaccaatgaggttggccttcgagtccagcatgagcgaggctacaatagcatccctacttttatcaaagcgtgggttgaacagtgtaaatcataccagaaagaagcaagatggttccacgggggacacacgcctccattggaagaatatagcttgaatggacttgtttccataggattccctctcttgttaatcacgggctacgtggcaatcgctgagaacgaggctgcactggataaagtgcacccccttcctgatcttctgcactactcctccctccttagtcgcctcatcaatgatataggaacgtctccggatgagatggcaatgggcgataatctgaagtcaatccattgttacatgaacgaaactggggcttccgaggaagttgctcgtgagcacataaagggagtaatcgaggagaattggaaaatactgaatcagtgctgctttgatcaatctcagtttcaggagccttttataaccttcaatttgaactctgttcgagggtctcatttcttctatgaatttggggatggctttggggtgacggatagctggacaaaggttgatatgaagtccgttttgatcgaccctattcctctcggcgaggagtag

SEQ ID NO: 23 - DNA, 1710 bp, Artificial Sequence
  Santalene synthase D549A
  ref <308>: DATABASE ACCESSION NUMBER: Genbank JQ690660
  ref <309>: DATABASE ENTRY DATE: 2013-05-11
atggattcttccaccgccaccgccatgacagctccattcattgatcctactgatcatgtgaatctcaaaactgatacggatgcctcagagaatcgaaggatgggaaattataaacccagcatttggaattatgattttttacaatcacttgcaactcatcacaatattgtggaagagaggcatctaaagctagctgagaagctgaagggccaagtgaagtttatgtttggggcaccaatggagccgttagcaaagctggagcttgtggatgtggttcaaaggcttgggctaaaccacctatttgagacagagatcaaggaagcgctgtttagtatttacaaggatgggagcaatggatggtggtttggccaccttcatgcgacatctctccgatttaggctgctacgacagtgtgggctttttattccccaagatgtgtttaaaacgttccaaaacaagactggggaatttgatatgaaactttgtgacaacgtaaaagggctgctgagcttatatgaagcttcatacttgggatggaagggtgaaaacatcctagatgaagccaaggccttcaccaccaagtgcttgaaaagtgcatgggaaaatatatccgaaaagtggttagccaaaagagtgaagcatgcattggctttgcctttgcattggagagtccctcgaatcgaagctagatggttcattgaggcatatgagcaagaagcgaatatgaacccaacactactcaaactcgcaaaattagactttaatatggtgcaatcaattcatcagaaagagattggggaattagcaaggtggtgggtgactactggcttggataagttagcctttgccaggaataatttactgcagagctatatgtggagctgcgcgattgcttccgacccgaagttcaaacttgctagagaaactattgtcgaaatcggaagtgtactcacagttgttgacgatggatatgacgtctatggttcaatcgacgaacttgatctctacacaagctccgttgaaaggtggagctgtgtggaaattgacaagttgccaaacacgttaaaattaatttttatgtctatgttcaacaagaccaatgaggttggccttcgagtccagcatgagcgaggctacaatagcatccctacttttatcaaagcgtgggttgaacagtgtaaatcataccagaaagaagcaagatggttccacgggggacacacgcctccattggaagaatatagcttgaatggacttgtttccataggattccctctcttgttaatcacgggctacgtggcaatcgctgagaacgaggctgcactggataaagtgcacccccttcctgatcttctgcactactcctccctccttagtcgcctcatcaatgatataggaacgtctccggatgagatggcaagaggcgataatctgaagtcaatccattgttacatgaacgaaactggggcttccgaggaagttgctcgtgagcacataaagggagtaatcgaggagaattggaaaatactgaatcagtgctgctttgatcaatctcagtttcaggagccttttataaccttcaatttgaactctgttcgagggtctcatttcttctatgaatttggggatggctttggggtgacggctagctggacaaaggttgatatgaagtccgttttgatcgaccctattcctctcggcgaggagtag

SEQ ID NO: 24 - DNA, 1710 bp, Artificial Sequence
  Santalene synthase Y539W
  ref <308>: DATABASE ACCESSION NUMBER: Genbank JQ690659
  ref <309>: DATABASE ENTRY DATE: 2013-05-11
atggattcttccaccgccaccgccatgacagctccattcattgatcctactgatcatgtgaatctcaaaactgatacggatgcctcagagaatcgaaggatgggaaattataaacccagcatttggaattatgattttttacaatcacttgcaactcatcacaatattgtggaagagaggcatctaaagctagctgagaagctgaagggccaagtgaagtttatgtttggggcaccaatggagccgttagcaaagctggagcttgtggatgtggttcaaaggcttgggctaaaccacctatttgagacagagatcaaggaagcgctgtttagtatttacaaggatgggagcaatggatggtggtttggccaccttcatgcgacatctctccgatttaggctgctacgacagtgtgggctttttattccccaagatgtgtttaaaacgttccaaaacaagactggggaatttgatatgaaactttgtgacaacgtaaaagggctgctgagcttatatgaagcttcatacttgggatggaagggtgaaaacatcctagatgaagccaaggccttcaccaccaagtgcttgaaaagtgcatgggaaaatatatccgaaaagtggttagccaaaagagtgaagcatgcattggctttgcctttgcattggagagtccctcgaatcgaagctagatggttcattgaggcatatgagcaagaagcgaatatgaacccaacactactcaaactcgcaaaattagactttaatatggtgcaatcaattcatcagaaagagattggggaattagcaaggtggtgggtgactactggcttggataagttagcctttgccaggaataatttactgcagagctatatgtggagctgcgcgattgcttccgacccgaagttcaaacttgctagagaaactattgtcgaaatcggaagtgtactcacagttgttgacgatggatatgacgtctatggttcaatcgacgaacttgatctctacacaagctccgttgaaaggtggagctgtgtggaaattgacaagttgccaaacacgttaaaattaatttttatgtctatgttcaacaagaccaatgaggttggccttcgagtccagcatgagcgaggctacaatagcatccctacttttatcaaagcgtgggttgaacagtgtaaatcataccagaaagaagcaagatggttccacgggggacacacgcctccattggaagaatatagcttgaatggacttgtttccataggattccctctcttgttaatcacgggctacgtggcaatcgctgagaacgaggctgcactggataaagtgcacccccttcctgatcttctgcactactcctccctccttagtcgcctcatcaatgatataggaacgtctccggatgagatggcaagaggcgataatctgaagtcaatccattgttacatgaacgaaactggggcttccgaggaagttgctcgtgagcacataaagggagtaatcgaggagaattggaaaatactgaatcagtgctgctttgatcaatctcagtttcaggagccttttataaccttcaatttgaactctgttcgagggtctcatttcttctgggaatttggggatggctttggggtgacggatagctggacaaaggttgatatgaagtccgttttgatcgaccctattcctctcggcgaggagtag

SEQ ID NO: 25 - DNA, 1710 bp, Artificial Sequence
  Santalene synthase W293F
  ref <308>: DATABASE ACCESSION NUMBER: Genbank JX046551
  ref <309>: DATABASE ENTRY DATE: 2013-05-11
atggattcttccaccgccaccgccatgacagctccattcattgatcctactgatcatgtgaatctcaaaactgatacggatgcctcagagaatcgaaggatgggaaattataaacccagcatttggaattatgattttttacaatcacttgcaactcatcacaatattgtggaagagaggcatctaaagctagctgagaagctgaagggccaagtgaagtttatgtttggggcaccaatggagccgttagcaaagctggagcttgtggatgtggttcaaaggcttgggctaaaccacctatttgagacagagatcaaggaagcgctgtttagtatttacaaggatgggagcaatggatggtggtttggccaccttcatgcgacatctctccgatttaggctgctacgacagtgtgggctttttattccccaagatgtgtttaaaacgttccaaaacaagactggggaatttgatatgaaactttgtgacaacgtaaaagggctgctgagcttatatgaagcttcatacttgggatggaagggtgaaaacatcctagatgaagccaaggccttcaccaccaagtgcttgaaaagtgcatgggaaaatatatccgaaaagtggttagccaaaagagtgaagcatgcattggctttgcctttgcattggagagtccctcgaatcgaagctagatggttcattgaggcatatgagcaagaagcgaatatgaacccaacactactcaaactcgcaaaattagactttaatatggtgcaatcaattcatcagaaagagattggggaattagcaaggtggtgggtgactactggcttggataagttagcctttgccaggaataatttactgcagagctatatgtttagctgcgcgattgcttccgacccgaagttcaaacttgctagagaaactattgtcgaaatcggaagtgtactcacagttgttgacgatggatatgacgtctatggttcaatcgacgaacttgatctctacacaagctccgttgaaaggtggagctgtgtggaaattgacaagttgccaaacacgttaaaattaatttttatgtctatgttcaacaagaccaatgaggttggccttcgagtccagcatgagcgaggctacaatagcatccctacttttatcaaagcgtgggttgaacagtgtaaatcataccagaaagaagcaagatggttccacgggggacacacgcctccattggaagaatatagcttgaatggacttgtttccataggattccctctcttgttaatcacgggctacgtggcaatcgctgagaacgaggctgcactggataaagtgcacccccttcctgatcttctgcactactcctccctccttagtcgcctcatcaatgatataggaacgtctccggatgagatggcaagaggcgataatctgaagtcaatccattgttacatgaacgaaactggggcttccgaggaagttgctcgtgagcacataaagggagtaatcgaggagaattggaaaatactgaatcagtgctgctttgatcaatctcagtttcaggagccttttataaccttcaatttgaactctgttcgagggtctcatttcttctatgaatttggggatggctttggggtgacggatagctggacaaaggttgatatgaagtccgttttgatcgaccctattcctctcggcgaggagtag

SEQ ID NO: 26 - DNA, 1710 bp, Artificial Sequence
  Santalene synthase G323V/Y324F
  ref <308>: DATABASE ACCESSION NUMBER: Genbank JQ690655
  ref <309>: DATABASE ENTRY DATE: 2013-05-11
atggattcttccaccgccaccgccatgacagctccattcattgatcctactgatcatgtgaatctcaaaactgatacggatgcctcagagaatcgaaggatgggaaattataaacccagcatttggaattatgattttttacaatcacttgcaactcatcacaatattgtggaagagaggcatctaaagctagctgagaagctgaagggccaagtgaagtttatgtttggggcaccaatggagccgttagcaaagctggagcttgtggatgtggttcaaaggcttgggctaaaccacctatttgagacagagatcaaggaagcgctgtttagtatttacaaggatgggagcaatggatggtggtttggccaccttcatgcgacatctctccgatttaggctgctacgacagtgtgggctttttattccccaagatgtgtttaaaacgttccaaaacaagactggggaatttgatatgaaactttgtgacaacgtaaaagggctgctgagcttatatgaagcttcatacttgggatggaagggtgaaaacatcctagatgaagccaaggccttcaccaccaagtgcttgaaaagtgcatgggaaaatatatccgaaaagtggttagccaaaagagtgaagcatgcattggctttgcctttgcattggagagtccctcgaatcgaagctagatggttcattgaggcatatgagcaagaagcgaatatgaacccaacactactcaaactcgcaaaattagactttaatatggtgcaatcaattcatcagaaagagattggggaattagcaaggtggtgggtgactactggcttggataagttagcctttgccaggaataatttactgcagagctatatgtggagctgcgcgattgcttccgacccgaagttcaaacttgctagagaaactattgtcgaaatcggaagtgtactcacagttgttgacgatgtatttgacgtctatggttcaatcgacgaacttgatctctacacaagctccgttgaaaggtggagctgtgtggaaattgacaagttgccaaacacgttaaaattaatttttatgtctatgttcaacaagaccaatgaggttggccttcgagtccagcatgagcgaggctacaatagcatccctacttttatcaaagcgtgggttgaacagtgtaaatcataccagaaagaagcaagatggttccacgggggacacacgcctccattggaagaatatagcttgaatggacttgtttccataggattccctctcttgttaatcacgggctacgtggcaatcgctgagaacgaggctgcactggataaagtgcacccccttcctgatcttctgcactactcctccctccttagtcgcctcatcaatgatataggaacgtctccggatgagatggcaagaggcgataatctgaagtcaatccattgttacatgaacgaaactggggcttccgaggaagttgctcgtgagcacataaagggagtaatcgaggagaattggaaaatactgaatcagtgctgctttgatcaatctcagtttcaggagccttttataaccttcaatttgaactctgttcgagggtctcatttcttctatgaatttggggatggctttggggtgacggatagctggacaaaggttgatatgaagtccgttttgatcgaccctattcctctcggcgaggagtag

SEQ ID NO: 27 - protein, 569 aa, Artificial Sequence
  Santalene bergamotene synthase 2
  ref <308>: DATABASE ACCESSION NUMBER: Genbank ADP30867
  ref <309>: DATABASE ENTRY DATE: 2010-11-06
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQNKTGEFDMKLWDNVKGLLSLYEASYLGWKGENILDEAKAFTTKCLKSAWENISEKWLAKRVKHALALPLHWRVPRIEARWFIEVYEQEANMNPTLLKLAKLDFNMVQSIHQKEIGELARWWVTTGLDKLDFARNNLLQSYMWSCAIASDPKFKLARETIVEIGSVLTVVDDGYDVYGSMDELDLYTSSVERWSCVKIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 28 - protein, 569 aa, Artificial Sequence
  Santalene synthase
  ref <310>: PATENT DOCUMENT NUMBER: WO2010067309
  ref <311>: PATENT FILING DATE: 2009-12-09
  ref <312>: PUBLICATION DATE: 2010-06-17
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQNKTGEFDMKLWDNVKGLLSLYEASYLGWKGENILDEAKAFTTKCLKSAWENISEKWLAKRVKHALALPLHWRVPRIEARWFIEVYEQEANMNPTLLKLAKLDFNMVQSIHQKEIGELARWWVTTGLDKLDFARNNLLQSYMWSCPIASDPKFKLARETIVEIGSVLTVVDDGYDVYGSMDELDLYTSSVERWSCVKIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 29 - protein, 569 aa, Artificial Sequence
  Santalene bergamotene synthase
  ref <310>: PATENT DOCUMENT NUMBER: WO2010067309
  ref <311>: PATENT FILING DATE: 2009-12-09
  ref <312>: PUBLICATION DATE: 2010-06-17
MDSSTATAMRAPFIDHTDHVNLRTDNDSSENRRMGNYKPSIWNYDFLQSLATRHNIMEERHLKLAEKLKGQVKFMFGAPMEPLAKLELVDVVQRLGLNHRFETEIKEALFSIYKDESNGWWFGHLHATSLRFRLLRQCGLFIPQDVFKTFQSKTGEFDMKLCDNVKGLLSLYEASFLGWRDENILDEAKAFATKYLKNAWENISQKWLAKRVKHALALPLHWRVPRIEARWFVEAYGEEENMNPTLLKLAKLDFNMVQSIHQKEIGELARWWVTTGLDKLAFARNNLLQSYMWSCAIASDPKFKLARETIVEIGSVLTVVDDAYDVYGSMDELDLYTNSVERWSCTEIDKLPNTLKLIFMAMFNKTNEVGLRVQHERGYSGITTFIKAWVEQCKSYQKEARWYHGGHTPPLEEYSLNGLVSIGFPLLLITGYVAIAENEAALDKVHPLPDLLHYSSLLSRLINDMGTSSDELERGDNLKSIQCYMNQTGASEKVAREHIKGIIEENWKILNECCFDQSQFQEPFVTFNLNSVRGSHFFYEFGDGFGVTNSWTKVDMKSVLIDPIPLDEE

SEQ ID NO: 30 - protein, 569 aa, Artificial Sequence
  Santalene synthase
  ref <310>: PATENT DOCUMENT NUMBER: WO2010067309
  ref <311>: PATENT FILING DATE: 2009-12-09
  ref <312>: PUBLICATION DATE: 2010-06-17
MDSSTATAMRAPFIDHTDHVNLRTDNDSSENRRMGNYKPSIWNYDFLQSLATRHNIMEERHLKLAEKLKGQVKFMFGAPMEPLAKLELVDVVQRLGLNHRFETEIKEALFSIYKDESNGWWFGHLHATSLRFRLLRQCGLFIPQDVFKTFQSKTGEFDMKLCDNVKGLLSLYEASFLGWRDENILDEAKAFATKYLKNAWENISQKWLAKRVKHALALPLHWRVPRIEARWFVEAYGEEENMNPTLLKLAKLDFNMVQSIHQKEIGELARWWVTTGLDKLAFARNNLLQSYMWSCAIASDPKFKLARETIVEIGSVLTVVDDAYDVYGSMDELDLYTNSVERWSCTEIDKLPNTLKLIFMSMFNKTNEVGLRVQHERGYSGITTFIKAWVEQCKSYQKEARWYHGGHTPPLEEYSLNGLVSIGFPLLLITGYVAIAENEAALDKVHPLPDLLHYSSLLSRLINDMGTSSDELERGDNLKSIQCYMNQTGASEKVAREHIKGIIEENWKILNECCFDQSQFQEPFVTFNLNSVRGSHFFYEFGDGFGVTDSWTKVDMKSVLIDPIPLDEE

SEQ ID NO: 31 - protein, 551 aa, Artificial Sequence
  Santalene synthase
  ref <310>: PATENT DOCUMENT NUMBER: WO2010067309
  ref <311>: PATENT FILING DATE: 2009-12-09
  ref <312>: PUBLICATION DATE: 2010-06-17
MATLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQNKTGEFDMKLWDNVKGLLSLYEASYLGWKGENILDEAKAFTTKCLKSAWENISEKWLAKRVKHALALPLHWRVPRIEARWFIEVYEQEANMNPTLLKLAKLDFNMVQSIHQKEIGELARWWVTTGLDKLDFARNNLLQSYMWSCAIASDPKFKLARETIVEIGSVLTVVDDGYDVYGSMDELDLYTSSVERWSCVKIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 32 - protein, 548 aa, Artificial Sequence
  Santalene synthase
  ref <310>: PATENT DOCUMENT NUMBER: WO2010067309
  ref <311>: PATENT FILING DATE: 2009-12-09
  ref <312>: PUBLICATION DATE: 2010-06-17
MATDNDSSENRRMGNYKPSIWNYDFLQSLATRHNIMEERHLKLAEKLKGQVKFMFGAPMEPLAKLELVDVVQRLGLNHRFETEIKEALFSIYKDESNGWWFGHLHATSLRFRLLRQCGLFIPQDVFKTFQSKTGEFDMKLCDNVKGLLSLYEASFLGWRDENILDEAKAFATKYLKNAWENISQKWLAKRVKHALALPLHWRVPRIEARWFVEAYGEEENMNPTLLKLAKLDFNMVQSIHQKEIGELARWWVTTGLDKLAFARNNLLQSYMWSCAIASDPKFKLARETIVEIGSVLTVVDDAYDVYGSMDELDLYTNSVERWSCTEIDKLPNTLKLIFMAMFNKTNEVGLRVQHERGYSGITTFIKAWVEQCKSYQKEARWYHGGHTPPLEEYSLNGLVSIGFPLLLITGYVAIAENEAALDKVHPLPDLLHYSSLLSRLINDMGTSSDELERGDNLKSIQCYMNQTGASEKVAREHIKGIIEENWKILNECCFDQSQFQEPFVTFNLNSVRGSHFFYEFGDGFGVTNSWTKVDMKSVLIDPIPLDEE

SEQ ID NO: 33 - protein, 569 aa, Artificial Sequence
  Santalene synthase Y539F
  ref <308>: DATABASE ACCESSION NUMBER: Genbank AFJ79632
  ref <309>: DATABASE ENTRY DATE: 2013-05-11
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFFEFGDGFGVTDSWTKVDMKSVLIDPIPLGEE

SEQ ID NO: 34 - protein, 569 aa, Artificial Sequence
  Santalene synthase Y324F
  ref <308>: DATABASE ACCESSION NUMBER: Genbank AFJ79630
  ref <309>: DATABASE ENTRY DATE: 2013-05-11
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGFDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 35 - protein, 569 aa, Artificial Sequence
  Santalene synthase T318A
  ref <308>: DATABASE ACCESSION NUMBER: Genbank AFJ79631
  ref <309>: DATABASE ENTRY DATE: 2013-05-11
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLAVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 36 - protein, 569 aa, Artificial Sequence
  Santalene synthase I422A
  ref <308>: DATABASE ACCESSION NUMBER: Genbank AFO63678
  ref <309>: DATABASE ENTRY DATE: 2012-07-31
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSAGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 37 - protein, 569 aa, Artificial Sequence
  Santalene synthase R284M
  ref <308>: DATABASE ACCESSION NUMBER: Genbank AFO63676
  ref <309>: DATABASE ENTRY DATE: 2013-05-11
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFAMNNLLQSYMWSCAIASDPKFKLARETIVEIGSVLTVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 38 - protein, 569 aa, Artificial Sequence
  Santalene synthase R474L
  ref <308>: DATABASE ACCESSION NUMBER: Genbank AFO63675
  ref <309>: DATABASE ENTRY DATE: 2012-07-31
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMALGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 39 - protein, 569 aa, Artificial Sequence
  Santalene synthase R474M
  ref <308>: DATABASE ACCESSION NUMBER: Genbank AFO63674
  ref <309>: DATABASE ENTRY DATE: 2012-07-31
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMAMGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 40 - protein, 569 aa, Artificial Sequence
  Santalene synthase D549A
  ref <308>: DATABASE ACCESSION NUMBER: Genbank AFJ79634
  ref <309>: DATABASE ENTRY DATE: 2013-05-11
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTASWTKVDMKSVLIDPIPLGEE

SEQ ID NO: 41 - protein, 569 aa, Artificial Sequence
  Santalene synthase Y539W
  ref <308>: DATABASE ACCESSION NUMBER: Genbank AFJ79633
  ref <309>: DATABASE ENTRY DATE: 2013-05-11
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFWEFGDGFGVTDSWTKVDMKSVLIDPIPLGEE

SEQ ID NO: 42 - protein, 569 aa, Artificial Sequence
  Santalene synthase W293F
  ref <308>: DATABASE ACCESSION NUMBER: Genbank AFO63677
  ref <309>: DATABASE ENTRY DATE: 2012-07-31
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMFSCAIASDPKFKLARETIVEIGSVLTVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 43 - protein, 569 aa, Artificial Sequence
  Santalene synthase G323V/Y324F
  ref <308>: DATABASE ACCESSION NUMBER: Genbank AFJ79626
  ref <309>: DATABASE ENTRY DATE: 2013-05-11
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDVFDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 44 - DNA, 1710 bp, Artificial Sequence
  codon-optimized Santalum spicatum santalene synthase
atggactcttctactgctaccgctactactgctccttttattgatcataccgatcacgtcaacttgaagatcgataacgattcctctgaatccagaagaatgggtaattacaagccatccatttggaactacgatttcttgcaatccttggccattcatcacaacatcgttgaagaaaagcacttgaagttggccgaaaaattgaagggtcaagtcatgtctatgtttggtgctccaatggaaccattggctaaattggaattggttgatgtcgttcaaagattgggtttgaaccatcaattcgaaaccgaaatcaaagaagccttgttctccgtttacaaggatggttctaatggttggtggtttggtcacttgcatgctacatctttgagattcagattattgagacaatgcggtttgttcatcccacaagatgttttcaagaccttccaatctaagaccgatgaattcgatatgaagttgtgcgataacatcaagggtttgttgtccttgtacgaagcttcatttttgggttggaagggtgaaaacatattggatgaagctaaagctttcgccactaagtacttgaaaaatgcctgggaaaacatttcccaaaagtggttggctaaaagagttaagcacgctttggctttgccattgcattggagagttccaagaattgaagctagatggttcattgaagcctacgaacaagaagaaaacatgaacccaactttgttgaaattggccaagttggatttcaacatggtccaatccatccaccaaaaagaaattggtgaattggcaagatggtgggttactactggtttggataagttggcttttgccagaaacaacttgttgcaatcttacatgtggtcttgcgctattgcttctgatccaaagtttaagttggccagagaaaccattgtcgaaatcggttctgttttgaccgttgttgatgatgcttatgatgtctacggttccatggatgaattggatcattacacctactctgtcgaaagatggtcttgtgtcgaaattgataagttgccaaacactttgaagttgatcttcatgtccatgttcaacaagaccaacgaagttggtttgagagttcaacacgaaagaggttataacggtattccaacctttattaaggcctgggttgaacaatgtaaggcctatcaaaaagaagccagatggtatcacggtggtcatactccaccattggaagaatattcattgaacggtttggtttccatcggtttccctttgttgttgattactggttacattgctatcgctgaaaacgaagctgctttggacaaagttcatccattgccagatttgttgcactactcatctttgttgtcaagattgatcaacgatatgggtacttctccagacgaaatggctagaggtgataacttgaaatctatccactgctacatgaacgaaactggtgcttctgaagaagttgctagagaacatattaagggtatcatcgaagaaaactggaagattttgaatcaatgctgcttcgaccaatctcaattccaagaaccattcattacctttaacttgaactccgttagaggttcccatttcttttacgaatttggtgatggtttcggtgttactgattcttggacaaaagttgacatgaagtccgttttgattgacccaattccattgggtgaagaatga

SEQ ID NO: 45 - DNA, 1707 bp, Artificial Sequence
  Santalene synthase SaSSy-1
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatcatattgattctgataaagctgatttgcacgctacatccttgagattcagattattgagacaatgcggtttgttcatcccacaagacgttttcaagaccttccaaaacaagactggtgaattcgatatgaagttgtgcgataacgttaagggtttgttgtccttgtatgaagcttcttacttgggttggaagggtgaaaacattttggatgaagctaaggctttcactaccaagtgtttgaaatccgcttgggaaaacatttctgaaaagtggttggccaaaagagttaagcacgctttggctttgccattgcattggagagttccaagaattgaagccagatggttcattgaagcctacgaacaagaggctaacatgaacccaaccttgttgaagttggcaaagttggatttcaacatggttcaatccatccaccaaaaagaaattggtgaattggctagatggtgggttactactggtttggataagttggctttcgctagaaacaacttgttgcaatcctacatgtggtcttgtgctattgcttctgacccaaagtttaagttggccagagaaaccatagttgaaatcggttccgttttgaccgttgttgatgatggttacgatgtttacggttccatcgatgaattggacttgtacacctcttctgttgaaagatggtcctgcgctgaaattgataagttgccaaacaccttgaagttgatcttcatgtccatgttcaacaagactaacgaagttggtttgagagttcaacacgaaagaggttacaactctatcccaacccttattaaggcttgggtcgaacaatgtaaatcttaccaaaaagaagctcgttggttccacggtggtcatactccaccattggaagaatattccttgaacggtttggtttctattggtttccctttgttgttgattacaggttacgttgctattgctgaaaatgaagccgctttggataaggttcatccattgccagatttgttgcactactcatccttgttgtccagattgatcaacgatattggtacttctccagacgaaatggctagaggtgataacttgaagtccatccactgttacatgaacgaaactggtgcttctgaagaagttgctagagaacacatcaagggtgtcattgaagaaaactggaagatcttgaatcaatgctgcttcgatcaatcccaattccaagaaccattcatcaccttcaacttgaactctgttagaggttcccatttcttctacgaattcggtgatggttttggtgttactgattcctggaccaaggttgatatgaagtccgttttgatcgatccaattccattgggtgaagaatga

SEQ ID NO: 46 - DNA, 1710 bp, Artificial Sequence
  Santalene synthase SaSSy-2
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatggttctaatggttggtggtttggtcacttgcatgctacatccttgagattcagattattgagacaatgcggtttgttcatcccacaagatgttttcaagaccttccaatctaagaccgatgaattcgatatgaagttgtgcgataacatcaagggtttgttgtccttgtacgaagcttcatttttgggttggaagggtgaaaacatattggatgaagctaaagctttcgccactaagtacttgaaaaatgcctgggaaaacatttcccaaaagtggttggctaaaagagttaagcacgctttggctttgccattgcattggagagttccaagaattgaagctagatggttcattgaagcctacgaacaagaagaaaacatgaacccaactttgttgaaattggccaagttggatttcaacatggtccaatccatccaccaaaaagaaattggtgaattggcaagatggtgggttactactggtttggataagttggcttttgccagaaacaacttgttgcaatcttacatgtggtcttgcgctattgcttctgatccaaagtttaagttggccagagaaaccattgtcgaaatcggttctgttttgaccgttgttgatgatgcttatgatgtctacggttccatggatgaattggatcattacacctactctgtcgaaagatggtcttgtgtcgaaattgataagttgccaaacactttgaagttgatcttcatgtccatgttcaacaagaccaacgaagttggtttgagagttcaacacgaaagaggttataacggtattccaacctttattaaggcctgggttgaacaatgtaaggcctatcaaaaagaagccagatggtatcacggtggtcatactccaccattggaagaatattcattgaacggtttggtttccatcggtttccctttgttgttgattactggttacattgctatcgctgaaaacgaagctgctttggacaaagttcatccattgccagatttgttgcactactcatctttgttgtcaagattgatcaacgatatgggtacttctccagacgaaatggctagaggtgataacttgaaatctatccactgctacatgaacgaaactggtgcttctgaagaagttgctagagaacatattaagggtatcatcgaagaaaactggaagattttgaatcaatgctgcttcgaccaatctcaattccaagaaccattcattacctttaacttgaactccgttagaggttcccatttcttttacgaatttggtgatggtttcggtgttactgattcttggacaaaagttgacatgaagtccgttttgattgacccaattccattgggtgaagaatga

SEQ ID NO: 47 - DNA, 1659 bp, Artificial Sequence
  Santalene synthase SaSSy-3
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgttgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 48 - DNA, 1659 bp, Artificial Sequence
  Santalene synthase SaSSy-4
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtactatggatgaattggatcattacacctactctgtcgaaagatggtcttgtgtcgaaattgataagttgccaaacaccttgaagttgatcttcatgtctatgtttaacaagacctccgaagttggtttgagagttcaacacgaaagaggttataacggtattccaactttgattaaggcctgggttgaacaatgtaaggcctatcaaaaagaagccagatggtatcacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 49 - DNA, 1704 bp, Artificial Sequence
  Santalene synthase SaSSy-5
atggactcttctactgctaccgctactactgctccttttattgatccaaccaatcacgtcaacttgaagatcgataacgattcctctgaaaacagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtagcatggatgaattggacttgtacacctcttctgttgaaagatggtcctgcgttgaaattgataagttgccaaacaccttgaagttgatcttcatgtccatgttcaacaagactaacgaagttggtttgagagttcaacacgaaagaggttacaacggtattccaactttgattaaggcctgggttgaacaatgtaaggcctatcaaaaagaagccagatggtatcacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 50 - DNA, 1659 bp, Artificial Sequence
  Santalene synthase SaSSy-6
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 51 - DNA, 1710 bp, Artificial Sequence
  Santalene synthase SaSSy-7
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgagaaaatggaaccattggctcagttggaattggttgacgttgttcaaagattgggtttgaaccacttgttcgaaaccgaaatcaaagaagccttgttctccatctacaaggatggttctaatggttggtggtttggtcacttgcatgctacatccttgagattcagattattgagacaatgcggtttgttcatcccacaagacgttttcaagaccttccaaaacaagactggtgaattcgatatgaagttgtgcgataacgttaagggtttgttgtccttgtatgaagcttcttacttgggttggaagggtgaaaacattttggatgaagctaaggctttcactaccaagtgtttgaaatccgcttgggaaaacatttctgaaaagtggttggccaaaagagttaagcacgctttggctttgccattgcattggagagttccaagaattgaagccagatggttcattgaagcctacgaacaagaggctaacatgaacccaaccttgttgaagttggcaaagttggatttcaacatggttcaatccatccaccaaaaagaaattggtgaattggctagatggtgggttactactggtttggataagttggctttcgctagaaacaacttgttgcaatcctacatgtggtcttgtgctattgcttctgacccaaagtttaagttggccagagaaaccatagttgaaatcggttccgttttgaccgttgttgatgatggttacgatgtttacggttccatcgatgaattggacttgtacacctcttctgttgaaagatggtcctgcgttgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattccttgaacggtttggtttctattggtttccctttgttgttgattacaggttacgttgctattgctgaaaatgaagccgctttggataaggttcatccattgccagatttgttgcactactcatccttgttgtccagattgatcaacgatattggtacttctccagacgaaatggctagaggtgataacttgaagtccatccactgttacatgaacgaaactggtgcttctgaagaagttgctagagaacacatcaagggtgtcattgaagaaaactggaagatcttgaatcaatgctgcttcgatcaatcccaattccaagaaccattcatcaccttcaacttgaactctgttagaggttcccatttcttctacgaattcggtgatggttttggtgttactgattcctggaccaaggttgatatgaagtccgttttgatcgatccaattccattgggtgaagaatga

SEQ ID NO: 52 - DNA, 1710 bp, Artificial Sequence
  Santalene synthase SaSSy-8
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaggatactgctaaaggaaaaaatggaaccattggctaagttggaattggttgacgttgttcaaagattgggtttgaaccacttgttcgaaaccgaaatcaaagaagccttgttctccatctacaaggatggttctaatggttggtggtttggccacttgcatgctacatccttgagattcagattattgagacaatgcggtttgttcatcccacaagacgttttcaagaccttccaaaacaagactggtgaattcgatatgaagttgtgcgataacgttaagggtttgttgtccttgtatgaagcttcttacttgggttggaagggtgaaaacattttggatgaagctaaggctttcactaccaagtgtttgaaatccgcttgggaaaacatttctgaaaagtggttggccaaaagagttaagcacgctttggctttgccattgcattggagagttccaagaattgaagccagatggttcattgaagcctacgaacaagaggctaacatgaacccaaccttgttgaagttggcaaagttggatttcaacatggttcaatccatccaccaaaaagaaattggtgaattggctagatggtgggttactactggtttggataagttggctttcgctagaaacaacttgttgcaatcctacatgtggtcttgtgctattgcttctgacccaaagtttaagttggccagagaaaccatagttgaaatcggttccgttttgaccgttgttgatgatggttacgatgtttacggttccatcgatgaattggacttgtacacctcttctgttgaaagatggtcctgcgttgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattccttgaacggtttggtttctattggtttccctttgttgttgattacaggttacgttgctattgctgaaaatgaagccgctttggataaggttcatccattgccagatttgttgcactactcatccttgttgtccagattgatcaacgatattggtacttctccagacgaaatggctagaggtgataacttgaagtccatccactgttacatgaacgaaactggtgcttctgaagaagttgctagagaacacatcaagggtgtcattgaagaaaactggaagatcttgaatcaatgctgcttcgatcaatcccaattccaagaaccattcatcaccttcaacttgaactctgttagaggttcccatttcttctacgaattcggtgatggttttggtgttactgattcctggaccaaggttgatatgaagtccgttttgatcgatccaattccattgggtgaagaatga

SEQ ID NO: 53 - DNA, 1710 bp, Artificial Sequence
  Santalene synthase SaSSy-9
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaggatactgctaaaggaaaaaatggaaccattggctaagttggaattggttgacgttgttcaaagattgggtttgaaccacttgttcgaaaccgaaatcaaagaagccttgttctccatctacaaggatggttctaatggttggtggtttggtcacttgcatgctacatccttgagattcagattattgagacaatgcggtttgttcatcccacaagacgttttcaagaccttccaaaacaagactggtgaattcgatatgaagttgtgcgataacgttaagggtttgttgtccttgtatgaagcttcttacttgggttggaagggtgaaaacattttggatgaagctaaggctttcactaccaagtgtttgaaatccgcttgggaaaacatttctgaaaagtggttggccaaaagagttaagcacgctttggctttgccattgcattggagagttccaagaattgaagccagatggttcattgaagcctacgaacaagaggctaacatgaacccaaccttgttgaagttggcaaagttggatttcaacatggttcaatccatccaccaaaaagaaattggtgaattggctagatggtgggttactactggtttggataagttggctttcgctagaaacaacttgttgcaatcctacatgtggtcttgtgctattgcttctgacccaaagtttaagttggccagagaaaccatagttgaaatcggttccgttttgaccgttgttgatgatggttacgatgtttacggttccatcgatgaattggacttgtacacctcttctgttgaaagatggtcctgcgttgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattccttgaacggtttggtttctattggtttccctttgttgttgattacaggttacgttgctattgctgaaaatgaagccgctttggataaggttcatccattgccagatttgttgcactactcatccttgttgtccagattgatcaacgatattggtacttctccagacgaaatggctagaggtgataacttgaagtccatccactgttacatgaacgaaactggtgcttctgaagaagttgctagagaacacatcaagggtgtcattgaagaaaactggaagatcttgaatcaatgctgcttcgatcaatcccaattccaagaaccattcatcaccttcaacttgaactctgttagaggttcccatttcttctacgaattcggtgatggttttggtgttactgattcctggaccaaggttgatatgaagtccgttttgatcgatccaattccattgggtgaagaatga

SEQ ID NO: 54 - DNA, 1665 bp, Artificial Sequence
  Santalene synthase SaSSy-10
atggccccagctatagtgatgagtaactacgaagaggaggagattgttagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatggttctaatggttggtggtttggtcacttgcatgctacatccttgagattcagattattgagacaatgcggtttgttcatcccacaagacgttttcaagaccttccaaaacaagactggtgaattcgatatgaagttgtgcgataacgttaagggtttgttgtccttgtatgaagcttcttacttgggttggaagggtgaaaacattttggatgaagctaaggctttcactaccaagtgtttgaaatccgcttgggaaaacatttctgaaaagtggttggccaaaagagttaagcacgctttggctttgccattgcattggagagttccaagaattgaagccagatggttcattgaagcctacgaacaagaggctaacatgaacccaaccttgttgaagttggcaaagttggatttcaacatggttcaatccatccaccaaaaagaaattggtgaattggctagatggtgggttactactggtttggataagttggctttcgctagaaacaacttgttgcaatcctacatgtggtcttgtgctattgcttctgacccaaagtttaagttggccagagaaaccatagttgaaatcggttccgttttgaccgttgttgatgatggttacgatgtttacggtttcatcgatgaattggacttgtacacctcttctgttgaaagatggtcctgcgttgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattccttgaacggtttggtttctattggtttccctttgttgttgattacaggttacgttgctattgctgaaaatgaagccgctttggataaggttcatccattgccagatttgttgcactactcatccttgttgtccagattgatcaacgatattggtacttctccagacgaaatggctagaggtgataacttgaagtccatccactgttacatgaacgaaactggtgcttctgaagaagttgctagagaacacatcaagggtgtcattgaagaaaactggaagatcttgaatcaatgctgcttcgatcaatcccaattccaagaaccattcatcaccttcaacttgaactctgttagaggttcccatttcttctacgaattcggtgatggttttggtgttactgattcctggaccaaggttgatatgaagtccgttttgatcgatccaattccattgggtgaagaatga

SEQ ID NO: 55 - DNA, 1710 bp, Artificial Sequence
  Santalene synthase SaSSy-11
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtgttgcttaccattttgaaaccgaaatcaaagaagccttgttctccatctacaaggatggttctaatggttggtggtttggtcacttgcatgctacatccttgagattcagattattgagacaatgcggtttgttcatcccacaagacgttttcaagaccttccaaaacaagactggtgaattcgatatgaagttgtgcgataacgttaagggtttgttgtccttgtatgaagcttcttacttgggttggaagggtgaaaacattttggatgaagctaaggctttcactaccaagtgtttgaaatccgcttgggaaaacatttctgaaaagtggttggccaaaagagttaagcacgctttggctttgccattgcattggagagttccaagaattgaagccagatggttcattgaagcctacgaacaagaggctaacatgaacccaaccttgttgaagttggcaaagttggatttcaacatggttcaatccatccaccaaaaagaaattggtgaattggctagatggtgggttactactggtttggataagttggctttcgctagaaacaacttgttgcaatcctacatgtggtcttgtgctattgcttctgacccaaagtttaagttggccagagaaaccatagttgaaatcggttccgttttgaccgttgttgatgatggttacgatgtttacggttccatcgatgaattggacttgtacacctcttctgttgaaagatggtcctgcgttgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattccttgaacggtttggtttctattggtttccctttgttgttgattacaggttacgttgctattgctgaaaatgaagccgctttggataaggttcatccattgccagatttgttgcactactcatccttgttgtccagattgatcaacgatattggtacttctccagacgaaatggctagaggtgataacttgaagtccatccactgttacatgaacgaaactggtgcttctgaagaagttgctagagaacacatcaagggtgtcattgaagaaaactggaagatcttgaatcaatgctgcttcgatcaatcccaattccaagaaccattcatcaccttcaacttgaactctgttagaggttcccatttcttctacgaattcggtgatggttttggtgttactgattcctggaccaaggttgatatgaagtccgttttgatcgatccaattccattgggtgaagaatga

SEQ ID NO: 56 - DNA, 1710 bp, Artificial Sequence
  Santalene synthase SaSSy-12
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtgttgcttaccattttgaaaccgaaatcaaagaagccttgttctccatctacaaggatggttctaatggttggtggtttggtcacttgcatgctacatccttgagattcagattattgagacaatgcggtttgttcatcccacaagacgttttcaagaccttccaaaacaagactggtgaattcgatatgaagttgtgcgataacgttaagggtttgttgtccttgtatgaagcttcttacttgggttggaagggtgaaaacattttggatgaagctaaggctttcactaccaagtgtttgaaatccgcttgggaaaacatttctgaaaagtggttggccaaaagagttaagcacgctttggctttgccattgcattggagagttccaagaattgaagccagatggttcattgaagcctacgaacaagaggctaacatgaacccaaccttgttgaagttggcaaagttggatttcaacatggttcaatccatccaccaaaaagaaattggtgaattggctaggtggtgggttactactggtttggataagttggctttcgctagaaacaacttgttgcaatcctacatgtggtcttgtgctattgcttctgacccaaagtttaagttggccagagaaaccatagttgaaatcggttccgttttgaccgttgttgatgatggttacgatgtttacggttccatcgatgaattggacttgtacacctcttctgttgaaagatggtcctgcgttgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattccttgaacggtttggtttctattggtttccctttgttgttgattacaggttacgttgctattgctgaaaatgaagccgctttggataaggttcatccattgccagatttgttgcactactcatccttgttgtccagattgatcaacgatattggtacttctccagacgaaatggctagaggtgataacttgaagtccatccactgttacatgaacgaaactggtgcttctgaagaagttgctagagaacacatcaagggtgtcattgaagaaaactggaagatcttgaatcaatgctgcttcgatcaatcccaattccaagaaccattcatcaccttcaacttgaactctgttagaggttcccacttcttctacgaattcggtgatggttttggtgttactgattcctggaccaaggttgatatgaagtccgttttgatcgatccaattccattgggtgaagaatga

SEQ ID NO: 57 - DNA, 1713 bp, Artificial Sequence
  Santalene synthase SaSSy-13
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcgagtttatgttcggtgctccaatggaaccattggctaagttggaattggttgacgttgttcaaagattgggtttgaaccacttgttcgaaaccgaaatcaaagaagccttgttctccatctacaaggattttcatgactgcaatgatatggatggtgatctccatgctacatccttgagattcagattattgagacaatgcggtttgttcatcccacaagacgttttcaagaccttccaaaacaagactggtgaattcgatatgaagttgtgcgataacgttaagggtttgttgtccttgtatgaagcttcttacttgggttggaagggtgaaaacattttggatgaagctaaggctttcactaccaagtgtttgaaatccgcttgggaaaacatttctgaaaagtggttggccaaaagagttaagcacgccttggctttgccattgcattggagagttccaagaattgaagccagatggttcattgaagcctacgaacaagaggctaacatgaacccaaccttgttgaagttggcaaagttggatttcaacatggttcaatccatccaccaaaaagaaattggtgaattggctagatggtgggttactactggtttggataagttggctttcgctagaaacaacttgttgcaatcctacatgtggtcttgtgctattgcttctgacccaaagtttaagttggccagagaaaccatagttgaaatcggttccgttttgaccgttgttgatgatggttacgatgtttacggttccatcgatgaattggacttgtacacctcttctgttgaaagatggtcctgcgttgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcctaccaaaaagaagctcgttggttccacggtggtcatactccaccattggaagaatattccttgaacggtttggtttctattggtttccctttgttgttgattacaggttacgttgctattgctgaaaatgaagccgctttggataaggttcatccattgccagatttgttgcactactcatccttgttgtccagattgatcaacgatattggtacttctccagacgaaatggctagaggtgataacttgaagtccatccactgttacatgaacgaaactggtgcttctgaagaagttgctagagaacacatcaagggtgtcattgaagaaaactggaagatcttgaatcaatgctgcttcgatcaatcccaattccaagaaccattcatcaccttcaacttgaactctgttagaggttcccatttcttctacgaattcggtgatggttttggtgttactgattcctggaccaaggttgatatgaagtccgttttgatcgatccaattccattgggtgaagaatga

SEQ ID NO: 58 - DNA, 1722 bp, Artificial Sequence
  Santalene synthase SaSSy-14
atggattcttccactgctactgctgtgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatcacaaatgctttcacaataatgaagtagagaaaatggatttgcatgctacatccttgagattcagattattgagacaatgcggtttgttcatcccacaagacgttttcaagaccttccaaaacaagactggtgaattcgatatgaagttgtgcgataacgttaagggtttgttgtccttgtatgaagcttcttacttgggttggaagggtgaaaacattttggatgaagctaaggctttcactaccaagtgtttgaaatccgcttgggaaaacatttctgaaaagtggttggccaaaagagttaagcacgctttggctttgccattgcattggagagttccaagaattgaagccagatggttcattgaagcctacgaacaagaggctaacatgaacccaaccttgttgaagttggcaaagttggatttcaacatggttcaatccatccaccaaaaagaaattggtgaattggctagatggtgggttactactggtttggataagttggctttcgctagaaacaacttgttgcaatcctacatgtggtcttgtgctattgcttctgacccaaagtttaagttggccagagaaaccatagttgaaatcggttccgttttgaccgttgttgatgatggttacgatgtttacggttccatcgatgaattggacttgtacacctcttctgttgaaagatggtcctgcgttgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattccttgaacggtttggtttctattggtttccctttgttgttgattacaggttacgttgctattgctgaaaatgaagccgctttggataaggttcatccattgccagatttgttgcactactcatccttgttgtccagattgatcaacgatattggtacttctccagacgaaatggctagaggtgataacttgaagtccatccactgttacatgaacgaaactggtgcttctgaagaagttgctagagaacacatcaagggtgtcattgaagaaaactggaagatcttgaatcaatgctgcttcgatcaatcccaattccaagaaccattcatcaccttcaacttgaactctgttagaggttcccatttcttctacgaattcggtgatggttttggtgttactgattcctggaccaaggttgatatgaagtccgttttgatcgatccaattccattgggtgaagaatga

SEQ ID NO: 59 - DNA, 1710 bp, Artificial Sequence
  Santalene synthase SaSSy-15
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatggttctaatggttggtggtttggtcacttgcatgctacatccttgagattcagattattgagacaatgcggtttgttcatcccacaagacgttttcaagaccttccaaaacaagactggtgaattcgatatgaagttgtgcgataacgttaagggtttgttgtccttgtatgaagcttcttacttgggttggaagggtgaaaacattttggatgaagctaaggctttcactaccaagtgtttgaaatccgcttgggaaaacatttctgaaaagtggttggccaaaagagttaagcacgctttggctttgccattgcattggagagttccaagaattgaagccagatggttcattgaagcctacgaacaagaggctaacatgaacccaaccttgttgaagttggcaaagttggatttcaacatggttcaatccatccaccaaaaagaaattggtgaattggctagatggtgggttactactggtttggataagttggctttcgctagaaacaacttgttgcaatcctacatgtggtcttgtgctattgcttctgacccaaagtttaagttggccagagaaaccatagttgaaatcggttccgttttgaccgttgttgatgatggttacgatgtgtatggatccttggaagaactccaattgttcactcaaacaatcgagaggtgggatattaattctctggataagttgccaaacaccttgaagttgatcttcatgtccatgttcaacaagactagcgaagttggtttgagagttcaacacgaaagaggttacaactctatcccaacctttattaaggcttgggtcgaacaatgtaaatcttaccaaaaagaagctcgctggttccacggtggtcatactccaccattggaagaatattccttgaacggtttggtttctattggtttccctttgttgttgattacaggttacgttgctattgctgaaaatgaagccgctttggataaggttcatccattgccagatttgttgcactactcatccttgttgtccagattgatcaacgatattggtacttctccagacgaaatggctagaggtgataacttgaagtccatccactgttacatgaacgaaactggtgcttctgaagaagttgctagagaacacatcaagggtgtcattgaagaaaactggaagatcttgaatcaatgctgcttcgatcaatcccaattccaagaaccattcatcaccttcaacttgaactctgttagaggttcccatttcttctacgaattcggtgatggttttggtgttactgattcctggaccaaggttgatatgaagtccgttttgatcgatccaattccattgggtgaagaatga

SEQ ID NO: 60 - DNA, 1707 bp, Artificial Sequence
  Santalene synthase SaSSy-16
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatggttctaatggttggtggtttggtcacttgcatgctacatccttgagattcagattattgagacaatgcggtttgttcatcccacaagacgttttcaagaccttccaaaacaagactggtgaattcgatatgaagttgtgcgataacgttaagggtttgttgtccttgtatgaagcttcttacttgggttggaagggtgaaaacattttggatgaagctaaggctttcactaccaagtgtttgaaagccatggtagaaagtttaggatatcatttggccaaaagagttaagcacgctttggctttgccattgcattggagagttccaagaattgaagccagatggttcattgaagcctacgaacaagaggctaacatgaacccaaccttgttgaagttggcaaagttggatttcaacatggttcaatccatccaccaaaaagaaattggtgaattggctagatggtgggttactactggtttggataagttggctttcgctagaaacaacttgttgcaatcctacatgtggtcttgtgctattgcttctgacccaaagtttaagttggccagagaaaccatagttgaaatcggttccgttttgaccgttgttgatgatggttacgatgtttacggttccatcgatgaattggacttgtacacctcttctgttgaaagatggtcctgcgttgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattccttgaacggtttggtttctattggtttccctttgttgttgattacaggttacgttgctattgctgaaaatgaagccgctttggataaggttcatccattgccagatttgttgcactactcatccttgttgtccagattgatcaacgatattggtacttctccagacgaaatggctagaggtgataacttgaagtccatccactgttacatgaacgaaactggtgcttctgaagaagttgctagagaacacatcaagggtgtcattgaagaaaactggaagatcttgaatcaatgctgcttcgatcaatcccaattccaagaaccattcatcaccttcaacttgaactctgttagaggttcccatttcttctacgaattcggtgatggttttggtgttactgattcctggaccaaggttgatatgaagtccgttttgatcgatccaattccattgggtgaagaatga

SEQ ID NO: 61 - DNA, 1710 bp, Artificial Sequence
  Santalene synthase SaSSy-17
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgctcgaaaccgaaatcaaagaagccttgttctccatctacaaggatggttctaatggttggtggtttggtcacttgcatgctacatccttgagattcagattattgagacaatgcggtttgttcatcccacaagacgttttcaagaccttccaaaacaagactggtgaattcgatatgaagttgtgcgataacgttaagggtttgttgtccttgtatgaagcttcttacttgggttggaagggtgaaaacattttggatgaagctaaggctttcactaccaagtgtttgaaatccgcttgggaaaacatttctgaaaagtggttggccaaaagagttaagcacgctttggctttgccattgcattggagagttccaagaattgaagccagatggttcattgaagcctacgaacaagaggctaacatgaacccaaccttgttgaagttggcaaagttggatttcaacatggttcaatccatccaccaaaaagaaattggtgaattggctagatggtgggttactactggtttggataagttggctttcgctagaaacaacttgttgcaatcctacatgtggtcttgtgctattgcttctgacccaaagtttaagttggccagagaaaccatagttgaaatcggttccgttttgaccgttgttgatgatggttacgatgtttacggttccatcgatgaattggacttgtacacctcttctgttgaaagatggtcctgcgttgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattccttgaacggtttggtttctattggtttccctttgttgttgattacaggttacgttgctattgctgaaaatgaagccgctttggataaggttcatccattgccagatttgttgcactactcatccttgttgtccagattgatcaacgatattggtacttctccagacgaaatggctagaggtgataacttgaagtccatccactgttacatgaacgaaactggtgcttctgaagaagttgctagagaacacatcaagggtgtcattgaagagaactggaagatcttgaatcaatgctgcttcgatcaatcccaattccaagaaccattcatcaccttcaacttgaactctgttagaggttcccatttcttctacgaattcggtgatggttttggtgttactgattcctggaccaaggttgatatgaagtccgttttgatcgatccaattccattgggtgaagaatga

SEQ ID NO: 62 - DNA, 1707 bp, Artificial Sequence
  Santalene synthase SaSSy-18
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatcatattgattctgataaagctgatttgcacgctacatccttgagattcagattattgagacaatgcggtttgttcatcccacaagacgttttcaagaccttccaaaacaagactggtgaattcgatatgaagttgtgcgataacgttaagggtttgttgtccttgtatgaagcttcttacttgggttggaagggtgaaaacattttggatgaagctaaagctttcgccactaagtacttgaaaaatgcctgggaaaacatttcccaaaagtggttggctaaaagagttaagcacgctttggctttgccattgcattggagagttccaagaattgaagctagatggttcattgaagcctacgaacaagaagaaaacatgaacccaactttgttgaaattggccaagttggatttcaacatggtccaatccatccaccaaaaagaaattggtgaattggcaagatggtgggttactactggtttggataagttggcttttgccagaaacaacttgttgcaatcttacatgtggtcttgcgctattgcttctgatccaaagtttaagttggccagagaaaccattgtcgaaatcggttctgttttgaccgttgttgatgatgcttatgatgtctacggttccatggatgaattggatcattacacctactctgtcgaaagatggtcttgtgccgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattccttgaacggtttggtttctattggtttccctttgttgttgattacaggttacgttgctattgctgaaaatgaagccgctttggataaggttcatccattgccagatttgttgcactactcatccttgttgtccagattgatcaacgatattggtacttctccagacgaaatggctagaggtgataacttgaagtccatccactgttacatgaacgaaactggtgcttctgaagaagttgctagagaacacatcaagggtgtcattgaagaaaactggaagatcttgaatcaatgctgcttcgatcaatcccaattccaagaaccattcatcaccttcaacttgaactctgttagaggttcccatttcttctacgaattcggtgatggttttggtgttactgattcctggaccaaggttgatatgaagtccgttttgatcgatccaattccattgggtgaagaatga

SEQ ID NO: 63 - DNA, 1707 bp, Artificial Sequence
  Santalene synthase SaSSy-19
atggattcttcctctgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatcatattgattctgataaagctgatttgcacgctacatccttgagattcagattattgagacaatgcggtttgttcatcccacaagacgttttcaagaccttccaaaacaagactggtgaattcgatatgaagttgtgcgataacgttaagggtttgttgtccttgtatgaagcttcttacttgggttggaagggtgaaaacattttggatgaagctaaagctttcgccactaagtacttgaaaaatgcctgggaaaacatttcccaaaagtggttggctaaaagagttaagcacgctttggctttgccattgcattggagagttccaagaattgaagctagatggttcattgaagcctacgaacaagaagaaaacatgaacccaactttgttgaaattggccaagttggatttcaacatggtccaatccatccaccaaaaagaaattggtgaattggcaagatggtgggttactactggtttggataagttggcttttgccagaaacaacttgttgcaatcttacatgtggtcttgcgctattgcttctgatccaaagtttaagttggccagagaaaccattgtcgaaatcggttctgttttgaccgttgttgatgatgcttatgatgtctacggttccatggatgaattggatcattacacctactctgtcgaaagatggtcttgtgccgaaattgataagttgccaaacactttgaagttgatcttcatgtccatgttcaacaagaccaacgaagttggtttgagagttcaacacgaaagaggttataacggtattccaacccttattaaggcctgggttgaacaatgtaaggcctatcaaaaagaagccagatggtatcacggtggtcatactccaccattggaagaatattcattgaacggtttggtttccatcggtttccctttgttgttgattactggttacattgctatcgctgaaaacgaagctgctttggacaaagttcatccattgccagatttgttgcactactcatctttgttgtcaagattgatcaacgatatgggtacttctccagacgaaatggctagaggtgataacttgaaatctatccactgctacatgaacgaaactggtgcttctgaagaagttgctagagaacatattaagggtatcatcgaagaaaactggaagattttgaatcaatgctgcttcgaccaatctcaattccaagaaccattcattacctttaacttgaactccgttagaggttcccatttcttttacgaatttggtgatggtttcggtgttactgattcttggacaaaagttgacatgaagtccgttttgattgacccaattccattgggtgaagaatga

SEQ ID NO: 64 - DNA, 1707 bp, Artificial Sequence
  Santalene synthase SaSSy-20
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatcatattgattctgataaagctgatttgcacgctacatccttgagattcagattattgagacaatgcggtttgttcatcccacaagacgttttcaagaccttccaaaacaagactggtgaattcgatatgaagttgtgcgataacgttaagggtttgttgtccttgtatgaagcttctcacttgggttggaagggtgaaaacattttggatgaagctaaagctttcgccactaagtacttgaaaaatgcctgggaaaacatttcccaaaagtggttggctaaaagagttaagcacgctttggctttgccattgcattggagagttccaagaattgaagctagatggttcattgaagcctacgaacaagaagaaaacatgaacccaactttgttgaaattggccaagttggatttcaacatggtccaatccatccaccaaaaagaaattggtgaattggcaagatggtgggttactactggtttggataagttggcttttgccagaaacaacttgttgcaatcttacatgtggtcttgcgctattgcttctgatccaaagtttaagttggccagagaaaccattgtcgaaatcggttctgttttgaccgttgttgatgatgcttatgatgtctacggttccatggatgaattggatcattacacctactctgtcgaaagatggtcttgtgtcgaaattgataagttgccaaacactttgaagttgatcttcatgtccatgttcaacaagaccaacgaagttggtttgagagttcaacacgaaagaggttataacggtattccaacctttattaaggcctgggttgaacaatgtaaggcctatcaaaaagaagccagatggtatcacggtggtcatactccaccattggaagaatattcattgaacggtttggtttccatcggtttccctttgttgttgattactggttacattgctatcgctgaaaacgaagctgctttggacaaagttcatccattgccagatttgttgcactactcatctttgttgtcaagattgatcaacgatatgggtacttctccagacgaaatggctagaggtgataacttgaaatctatccactgctacatgaacgaaactggtgcttctgaagaagttgctagagaacatattaagggtatcatcgaagaaaactggaagattttgaatcaatgctgcttcgaccaatctcaattccaagaaccattcattacctttaacttgaactccgttagaggttcccatttcttttacgaatttggtgatggtttcggtgttactgattcttggacaaaagttgacatgaagtccgttttgattgacccaattccattgggtgaagaatga

SEQ ID NO: 65 - DNA, 1707 bp, Artificial Sequence
  Santalene synthase SaSSy-21
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatcatattgattctgataaagctgatttgcacgctacatccttgagattcagattattgagacaatgcggtttgttcatcccacaagacgttttcaagaccttccaaaacaagactggtgaattcgatatgaagttgtgcgataacgttaagggtttgttgtccttgtatgaagcttcttacttgggttggaagggtgaaaacattttggatgaagctaaagctttcgccactaagtacttgaaaaatgcctgggaaaacatttcccaaaagtggttggctaaaagagttaagcacgctttggctttgccattgcattggagagttccaagaattgaagctagatggttcattgaagcctacgaacaagaagaaaacatgaacccaactttgttgaaattggccaagttggatttcaacatggtccaatccatccaccaaaaagaaattggtgaattggcaagatggtgggttactactggtttggataagttggcttttgccagaaacaacttgttgcaatcttacatgtggtcttgcgctattgcttctgatccaaagtttaagttggccagagaaaccattgtcgaaatcggttctgttttgaccgttgttgatgatgcttatgatgtctacggttccatggatgaattggatcattacacctactctgtcgaaagatggtcttgtgtcgaaattgataagttgccaaacactttgaagttgatcttcatgtccatgttcaacaagaccaacgaagttggtttgagagttcaacacgaaagaggttataacggtattccaacctttattaaggcctgggttgaacaatgtaaggcctatcaaaaagaagccagatggtatcacggtggtcatactccaccattggaagaatattcattgaacggtttggtttccatcggtttccctttgttgttgattactggttacattgctatcgctgaaaacgaagctgctttggacaaagttcatccattgccagatttgttgcactactcatctttgttgtcaagattgatcaacgatatgggtacttctccagacgaaatggctagaggtgataacttgaaatctatccactgctacatgaacgaaactggtgcttctgaagaagttgctagagaacatattaagggtatcatcgaagaaaactggaagattttgaatcaatgctgcttcgaccaatctcaattccaagaaccattcattacctttaacttgaactccgttagaggttcccatttcttttacgaatttggtgatggtttcggtgttactgattcttggacaaaagttgacatgaagtccgttttgattgacccaattccattgggtgaagaatga

SEQ ID NO: 66 - DNA, 1710 bp, Artificial Sequence
  Santalene synthase SaSSy-22
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaaagaaattgaagatgctattcaacaattgtgtccaattggttctaatggttggtggtttggtcacttgcatgctacatccttgagattcagattattgagacaatgcggtttgttcatcccacaagacgttttcaagaccttccaaaacaagactggtgaattcgatatgaagttgtgcgataacgttaagggtttgttgtccttgtatgaagcttcttacttgggttggaagggtgaaaacattttggatgaagctaaggctttcactaccaagtgtttgaaatccgcttgggaaaacatttctgaaaagtggttggccaaaagagttaagcacgctttggctttgccattgcattggagagttccaagaattgaagccagatggttcattgaagcctacgaacaagaggctaacatgaacccaaccttgttgaagttggcaaagttggatttcaacatggttcaatccatccaccaaaaagaaattggtgaattggctagatggtgggttactactggtttggataagttggctttcgctagaaacaacttgttgcaatcctacatgtggtcttgtgctattgcttctgacccaaagtttaagttggccagagaaaccatagttgaaatcggttccgttttgaccgttgttgatgatggttacgatgtttacggttccatcgatgaattggacttgtacacctcttctgttgaaagatggtcctgcgttgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattccttgaacggtttggtttctattggtttccctttgttgttgattacaggttacgttgctattgctgaaaatgaagccgctttggataaggttcatccattgccagatttgttgcactactcatccttgttgtccagattgatcaacgatattggtacttctccagacgaaatggctagaggtgataacttgaagtccatccactgttacatgaacgaaactggtgcttctgaagaagttgctagagaacacatcaagggtgtcattgaagaaaactggaagatcttgaatcaatgctgcttcgatcaatcccaattccaagaaccattcatcaccttcaacttgaactctgttagaggttcccatttcttctacgaattcggtgatggttttggtgttactgattcctggaccaaggttgatatgaagtccgttttgatcgatccaattccattgggtgaagaatga

SEQ ID NO: 67 - DNA, 1710 bp, Artificial Sequence
  Santalene synthase SaSSy-23
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatggttctaatggttggtggtttggtcacttgcatgctacatccttgagattcagattattgagacaacaaggtattaagatttcttgtgatgttttcgaacaatttaaggatgatgaaggtagattcaaaagttctttgattaatgatgttcaaggcatgttgtctttgtatgaagcttcttacttgggttggaagggtgaaaacattttggatgaagctaaagctttcgccactaagtacttgaaaaatgcctgggaaaacatttcccaaaagtggttggctaaaagagttaagcacgctttggctttgccattgcattggagagttccaagaattgaagctagatggttcattgaagcctacgaacaagaagaaaacatgaacccaactttgttgaaattggccaagttggatttcaacatggtccaatccatccaccaaaaagaaattggtgaattggcaagatggtgggttactactggtttggataagttggcttttgccagaaacaacttgttgcaatcttacatgtggtcttgcgctattgcttctgatccaaagtttaagttggccagagaaaccattgtcgaaatcggttctgttttgaccgttgttgatgatgcttatgatgtctacggttccatggatgaattggatcattacacctactctgtcgaaagatggtcttgtgtcgaaattgataagttgccaaacactttgaagttgatcttcatgtccatgttcaacaagaccaacgaagttggtttgagagttcaacacgaaagaggttataacggtattccaacctttattaaggcctgggttgaacaatgtaaggcctatcaaaaagaagccagatggtatcacggtggtcatactccaccattggaagaatattcattgaacggtttggtttccatcggtttccctttgttgttgattactggttacattgctatcgctgaaaacgaagctgctttggacaaagttcatccattgccagatttgttgcactactcatctttgttgtcaagattgatcaacgatatgggtacttctccagacgaaatggctagaggtgataacttgaaatctatccactgctacatgaacgaaactggtgcttctgaagaagttgctagagaacatattaagggtatcatcgaagaaaactggaagattttgaatcaatgctgcttcgaccaatctcaattccaagaaccattcattacctttaacttgaactccgttagaggttcccatttcttttacgaatttggtgatggtttcggtgttactgattcttggacaaaagttgacatgaagtccgttttgattgacccaattccattgggtgaagaatga

SEQ ID NO: 68 - DNA, 1710 bp, Artificial Sequence
  Santalene synthase SaSSy-24
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatggttctaatggttggtggtttggtcacttgcatgctacatccttgagattcagattattgagacaacaaggtattaagatttcttgtgatgttttcgaacaatttaaggatgatgaaggtagattcaaaagttctttgattaatgatgttcaaggcatgttgtctttgtatgaagcttcttacttgggttggaagggtgaaaacattttggatgaagctaaagctttcgccactaagtacttgaaaaatgcctgggaaaacatttcccaaaagtggttggctaaaagagttaagcacgctttggctttgccattgcattggagagttccaagaattgaagctagatggttcattgaagcctacgaacaagaagaaaacatgaacccaactttgttgaaattggccaagttggatttcaacatggtccaatccatccaccaaaaagaaattggtgaattggcaagatggtgggttactactggtttggataagttggcttttgccagaaacaacttgttgcaatcttacatgtggtcttgcgctattgcttctgatccaaagtttaagttggccagagaaaccattgtcgaaatcggttctgttttgaccgttgttgatgatgcttatgatgtctacggttccatggatgaattggatcattacacctactctgtcgaaagatggtcttgtgtcgaaattgataagttgccaaacactttgaagttgatcttcatgtccatgttcaacaagaccaacgaagttggtttgagagttcaacacgaaagaggttataacggtattccaacctttattaaggcctgggttgaacaatgtaaggcctatcaaaaagaagccagatggtatcacggtggtcatactccaccattggaagaatattcattgaacggtttggtttccatcggtttccctttgttgttgattactggttacattgctatcgctgaaaacgaagctgctttggacaaagttcatccattgccagatttgttgcactactcatctttgttgtcaagattgatcaacgatatgggtacttctccagacgaaatggctagaggtgataacttgaaatctatccactgctacatgaacgaaactggtgcttctgaagaagttgctagagaacatattaagggtatcatcgaagaaaactggaagattttgaatcaatgctgcttcgaccaatctcaattccgagaaccattcattacctttaacttgaactccgttagaggttcccatttcttttacgaatttggtgatggtttcggtgttactgattcttggacaaaagttgacatgaagtccgttttgattgacccaattccattgggtgaagaatga

SEQ ID NO: 69 - DNA, 1710 bp, Artificial Sequence
  Santalene synthase SaSSy-25
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatggttctaatggttggtggtttggtcacttgcatgctacatccttaagattcagattattgagacaacatggacatcatgttcctcaagaggttttctgcagtttcatggacgatgtaggaaatttcagggcgtggctgtgtgaagacgtgagagggctgctatcgttgtatgaagcttcttacttgggttggaagggtgaaaacattttggatgaagctaaggctttcactaccaagtgtttgaaatccgcttgggaaaacatttctgaaaagtggttggccaaaagagttaagcacgctttggctttgccattgcattggagagttccaagaattgaagccagatggttcattgaagcctacgaacaagaggctaacatgaacccaaccttgttgaagttggcaaagttggatttcaacatggttcaatccatccaccaaaaagaaattggtgaattggctagatggtgggttactactggtttggataagttggctttcgctagaaacaacttgttgcaatcctacatgtggtcttgtgctattgcttctgacccaaagtttaagttggccagagaaaccatagttgaaatcggttccgttttgaccgttgttgatgatggttacgatgtttacggttccatcgatgaattggacttgtacacctcttctgttgaaagatggtcctgcgttgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattccttgaacggtttggtttctattggtttccctttgttgttgattacaggttacgttgctattgctgaaaatgaagccgctttggataaggttcatccattgccagatttgttgcactactcatccttgttgtccagattgatcaacgatattggtacttctccagacgaaatggctagaggtgataacttgaagtccatccactgttacatgaacgaaactggtgcttctgaagaagttgctagagaacacatcaagggtgtcattgaagaaaactggaagatcttgaatcaatgctgcttcgatcaatcccaattccaagaaccattcatcaccttcaacttgaactctgttagaggttcccatttcttctacgaattcggtgatggttttggtgttactgattcctggaccaaggttgatatgaagtccgttttgatcgatccaattccattgggtgaagaatga

SEQ ID NO: 70 - DNA, 1710 bp, Artificial Sequence
  Santalene synthase SaSSy-26
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatggttctaatggttggtggtttggtcacttgcatgctacatccttgagattcagattattgagacaacaaggtattaagatttcttgtgatgttttcgaacaatttaaggatgatgaaggtagattcaaaagttctttgattaatgatgttcaaggcatgttgtctttgtatgaagcttcttacttgggttggaagggtgaaaacattttggatgaagctaaggctttcactaccaagtgtttgaaatccgcttgggaaaacatttctgaaaagtggttggccaaaagagttaagcacgctttggctttgccattgcattggagagttccaagaattgaagccagatggttcattgaagcctacgaacaagaggctaacatgaacccaaccttgttgaagttggcaaagttggatttcaacatggttcaatccatccaccaaaaagaaattggtgaattggctagatggtgggttactactggtttggataagttggctttcgctagaaacaacttgttgcaatcctacatgtggtcttgtgctattgcttctgacccaaagtttaagttggccagagaaaccatagttgaaatcggttccgttttgaccgttgttgatgatggttacgatgtttacggttccatcgatgaattggacttgtacacctcttctgttgaaagatggtcctgcgttgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattccttgaacggtttggtttctattggtttccctttgttgttgattacaggttacgttgctattgctgaaaatgaagccgctttggataaggttcatccattgccagatttgttgcactactcatccttgttgtccagattgatcaacgatattggtacttctccagacgaaatggctagaggtgataacttgaagtccatccactgttacatgaacgaaactggtgcttctgaagaagttgctagagaacacatcaagggtgtcattgaagaaaactggaagatcttgaatcaatgctgcttcgatcaatcccaattccaagaaccattcatcaccttcaacttgaactctgttagaggttcccatttcttctacgaattcggtgatggttttggtgttactgattcctggaccaaggttgatatgaagtccgttttgatcgatccaattccattgggtgaagaatga

SEQ ID NO: 71 - DNA, 1710 bp, Artificial Sequence
  Santalene synthase SaSSy-27
atggattcttccactgctactgctactactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatggttctaatggttggtggtttggtcacttgcatgctacatccttgagattcagattattgagacaatgcggtttgttcatcccacaagacgttttcaagaccttccaaaacaagactggtgaattcgatatgaagttgtgcgataacgttaagggtttgttgtccttgtatgaagcttcttacttgggttggaagggtgaaaacattttggatgaagctaaggctttcactaccaagtgtttgaaatccgcttgggaaaacatttctgaaaagtggttggccaaaagagttaagcacgctttggctttgccattgcattggagagttccaagaattgaagccagatggttcattgaagcctacgaacaagaggctaacatgaacccaaccttgttgaagttggcaaagttggatttcaacatggttcaatccatccaccgaaaagaaattggtgaattggctagatggtgggttactactggtttggataagttggctttcgctagaaacaacttgttgcaatcctacatgtggtcttgtgctattgcttctgacccaaagtttaagttggccagagaaaccatagttgaaatcggttccgttttgaccgttgttgatgatggttacgatgtttacggttccatcgatgaattggacttgtacacctcttctgttgaaagatggtcctgcgttgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattccttgaacggtttggtttctattggtttccctttgttgttgattacaggttacgttgctattgctgaaaatgaagccgctttggataaggttcatccattgccagatttgttgcactactcatccttgttgtccagattgatcaacgatattggtacttctccagacgaaatggctagaggtgataacttgaagtccatccactgttacatgaacgaaactggtgcttctgaagaagttgctagagaacacatcaagggtgtcattgaagaaaactggaagatcttgaatcaatgctgcttcgatcaatcccaattccaagaaccattcatcaccttcaacttgaactctgttagaggttcccatttcttctacgaattcggtgatggttttggtgttactgattcctggaccaaggttgatatgaagtccgttttgatcgatccaattccattgggtgaagaatga

SEQ ID NO: 72 - DNA, 1710 bp, Artificial Sequence
  Santalene synthase SaSSy-28
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatggttctaatggttggtggtttggtcacttgcatgctacatccttgagattcagattattgagacaatgcggtttgttcatcccacaagatgttttcaagaccttccaatctaagaccgatgaattcgatatgaagttgtgcgataacatcaagggtttgttgtccttgtacgaagcttcatttttgggttggaagggtgaaaacatattggatgaagctaaagctttcgccactaagtacttgaaaaatgcctgggaaaacatttcccaaaagtggttggctaaaagagttaagcacgctttggctttgccattgcattggagagttccaagaattgaagctagatggttcattgaagcctacgaacaagaagaaaacatgaacccaactttgttgaaattggccaagttggatttcaacatggtccaatccatccaccaaaaagaaattggtgaattggcaagatggtgggttactactggtttggataagttggcttttgccagaaacaacttgttgcaatcttacatgtggtcttgcgctattgcttctgatccaaagtttaagttggccagagaaaccattgtcgaaatcggttctgttttgaccgttgttgatgatgcttatgatgtctacggttccatggatgaattggatcattacacctactctgtcgaaagatggtcttgtgtcgaaattgataagttgccaaacactttgaagttgatcttcatgtccatgttcaacaagaccaacgaagttggtttgagagttcaacacgaaagaggttataacggtattccaacctttattaaggcctgggttgaacaatgtaaggcctatcaaaaagaagccagatggtatcacggtggtcatactccaccattggaagaatattcattgaacggtttggtttccatcggtttccctttgttgttgattactggttacattgctatcgctgaaaacgaagctgctttggacaaagttcatccattgccagatttgttgcactactcatctttgttgtcaagattgatcaacgatatgggtacttctccagacgaaatgccaagaggtgataacttgaaatctatccactgctacatgaacgaaactggtgcttctgaagaagttgctagagaacatattaagggtatcatcgaagaaaactggaagattttgaatcaatgctgcttcgaccaatctcaattccaagaaccattcattacctttaacttgaactccgttagaggttcccatttcttttacgaatttggtgatggtttcggtgttactgattcttggacaaaagttgacatgaagtccgttttgattgacccaattccattgggtgaagaatga

SEQ ID NO: 73 - DNA, 1710 bp, Artificial Sequence
  Santalene synthase SaSSy-29
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatggttctaatggttggtggtttggtcacttgcatgctacatccttgagattcagattattgagacaatgcggtttgttcatcccacaagatgttttcaagaccttccaatctaagaccgatgaattcgatatgaagttgtgcgataacatcaagggtttgttgtccttgtacgaagcttcatttttgggttggaagggtgaaaacatattggatgaagctaaagctttcgccactaagtacttgaaaaatgcctgggaaaacatttcccaaaagtggttggctaaaagagttaagcacgctttggctttgccattgcattggagagttccaagaattgaagctagatggttcattgaagcctacgaacaagaagaaaacatgaacccaactttgttgaaattggccaagttggatttcaacatggtccaatccatccaccaaaaagaaattggtgaattggcaagatggtgggttactactggtttggataagttggcttttgccagaaacaacttgttgcaatcttacatgtggtcttgcgctattgcttctgatccaaagtttaagttggccagagaaaccattgtcgaaatcggttctgttttgaccgttgttgatgatgcttatgatgtctacggtctgatggatgaattggatcattacacctactctgtcgaaagatggtcttgtgtcgaaattgataagttgccaaacactttgaagttgatcttcatgtccatgttcaacaagaccaacgaagttggtttgagagttcaacacgaaagaggttataacggtattccaacctttattaaggcctgggttgaacaatgtaaggcctatcaaaaagaagccagatggtatcacggtggtcatactccaccattggaagaatattcattgaacggtttggtttccatcggtttccctttgttgttgattactggttacattgctatcgctgaaaacgaagctgctttggacaaagttcatccattgccagatttgttgcactactcatctttgttgtcaagattgatcaacgatatgggtacttctccagacgaaatggctagaggtgataacttgaaatctatccactgctacatgaacgaaactggtgcttctgaagaagttgctagagaacatattaagggtatcatcgaagaaaactggaagattttgaatcaatgctgcttcgaccaatctcaattccaagaaccattcattacctttaacttgaactccgttagaggttcccatttcttttacgaatttggtgatggtttcggtgttactgattcttggacaaaagttgacatgaagtccgttttgattgacccaattccattgggtgaagaatga

SEQ ID NO: 74 - DNA, 1710 bp, Artificial Sequence
  Santalene synthase SaSSy-30
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatggttctaatggttggtggtttggtcacttgcatgctacatccttgagattcagattattgagacaatgcggtttgttcatcccacaagatgttttcaagaccttccaatctaagaccgatgaattcgatatgaagttgtgcgataacatcaagggtttgttgtccttgtacgaagcttcatttttgggttggaagggtgaaaacatattggatgaagctaaagctttcgccactaagtacttgaaaaatgcctgggaaaacatttcccaaaagtggttggctaaaagagttaagcacgctttggctttgccattgcattggagagttccaagaattgaagctagatggttcattgaagcctacgaacaagaagaaaacatgaacccaactttgttgaaattggccaagttggatttcagcatggtccaatccatccaccaaaaagaaattggtgaattggcaagatggtgggttactactggtttggataagttggcttttgccagaaacaacttgttgcaatcttacatgtggtcttgcgctattgcttctgatccaaagtttaagttggccagagaaaccattgtcgaaatcggttctgttttgaccgttgttgatgatgcttatgatgtctacggttccatggatgaattggatcattacacctactctgtcgaaagatggtcttgtgtcgaaattgataagttgccaaacactttgaagttgatcttcatgtccatgttcaacaagaccaacgaagttggtttgagagttcaacacgaaagaggttataacggtattccaacccttattaaggcctgggttgaacaatgtaaggcctatcaaaaagaagccagatggtatcacggtggtcatactccaccattggaagaatattcattgaacggtttggtttccatcggtttccctttgttgttgattactggttacattgctatcgctgaaaacgaagctgctttggacaaagttcatccattgccagatttgttgcactactcatctttgttgtcaagattgatcaacgatatgggtacttctccagacgaaatggctagaggtgataacttgaaatctatccactgctacatgaacgaaactggtgcttctgaagaagttgctagagaacatattaagggtatcatcgaagaaaactggaagattttgaatcaatgctgcttcgaccaatctcaattccaagaaccattcattacctttaacttgaactccgttagaggttcccatttcttttacgaatttggtgatggtttcggtgttactgattcttggacaaaagttgacatgaagtccgttttgattgacccaattccattgggtgaagaatga

SEQ ID NO: 75 - DNA, 1710 bp, Artificial Sequence
  Santalene synthase SaSSy-31
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatggttctaatggttggtggtttggtcacttgcatgctacatccttgagattcagattattgagacaatgcggtttgttcatcccacaagatgttttcaagaccttccaatctaagaccgatgaattcgatatgaagttgtgcgataacatcaagggtttgttgtccttgtacgaagcttcatttttgggttggaagggtgaaaacatattggatgaagctaaagctttcgccactaagtacttgaaaaatgcctgggaaaacatttcccaaaagtggttggctaaaagagttaagcacgctttggctttgccattgcattggagagttccaagaattgaagctagatggttcattgaagcctacgaacaagaagaaaacatgaacccaactttgttgaaattggccaagttggatttcaacatggtccaatccatccaccaaaaagaaattggtgaattggcaagatggtgggttactactggtttggataagttggcttttgccagaaacaacttgttgcaatcttacatgtggtcttgcgctattgcttctgatccaaagtttaagttggccagagaaaccattgtcgaaatcggttctgttttgaccgttgttgatgatgcttatgatgtctacggttccatggatgaattggatcattacacctactctgtcgaaagatggtcttgtgtcgaaattgataagttgccaaacactttgaagttgatcttcatgtccatgttcaacaagaccaacgaagttggtttgagagttcaacacgaaagaggttataacggtattccaacccttattaaggcctgggttgaacaatgtaaggcctatcaaaaagaagccagatggtatcacggtggtcatactccaccattggaagaatattcattgaacggtttggtttccatcggtttccctttgttgttgattactggttacattgctatcgctgaaaacgaagctgctttggacaaagttcatccattgccagatttgttgcactactcatctttgttgtcaagattgatcaacgatatgggtacttctccagacgaaatggctagaggtgataacttgaaatctatccactgctacatgaacgaaactggtgcttctgaagaagttgctagagaacatattaagggtatcatcgaagaaaactggaagattttgaatcaatgctgcttcgaccaatctcaattccaagaaccattcattacctttaacttgaactccgttagaggttcccatttcttttacgaatttggtgatggtttcggtgttactgattcttggacaaaagttgacatgaagtccgttttgattgacccaattccattgggtgaagaatga

SEQ ID NO: 76 - DNA, 1710 bp, Artificial Sequence
  Santalene synthase SaSSy-32
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatggttctaatggttggtggtttggtcacttgcatgctacatccttgagattcagattattgagacaatgcggtttgttcatcccacaagatgttttcaagaccttccaatctaagaccgatgaattcgatatgaagttgtgcgataacatcaagggtttgttgtccttgtacgaagcttcatttttgggttggaagggtgaaaacatattggatgaagctaaagctttcgccactaagtacttgaaaaatgcctgggaaaacatttcccaaaagtggttggctaaaagagttaagcacgctttggctttgccattgcattggagagttccaagaattgaagctagatggttcattgaagcctacgaacaagaagaaaacatgaacccaactttgttgaaattggccaagttggatttcaacatggtccaatccatccaccaaaaagaaattggtgaattggcaagatggtgggttactactggtttggataagttggcttttgccagaaacaacttgttgcaatcttacatgtggtcttgcgctattgcttctgatccaaagtttaagttggccagagaaaccattgtcgaaatcggttctgttttgaccgttgttgatgatgcttatgatgtctacggttccatggatgaattggatcattacacctactctgtcgaaagatggtcttgtgtcgaaattgataagttgccaaacactttgaagttgatcttcatgtccatgttcaacaagaccaacgaagttggtttgagagttcaacacgaaagaggttataacggtattccaacctttattaaggcctgggttgaacaatgtaaggcctatcaaaaagaagccagatggtatcacggtggtcatactccaccattggaagaatattcattgaacggtttggtttccatcggtttccctttgttgttgattactggttacattgctatcgctgaaaacgaagctgctttggacaaagttcatccattgccagatttgttgcactactcatctttgttgtcaagattgatcaacgatatgggtacttctccagacgaaatgccgagaggtgataacttgaaatctatccactgctacatgaacgaaactggtgcttctgaagaagttgctagagaacatattaagggtatcatcgaagaaaactggaagattttgaatcaatgctgcttcgaccaatctcaattccaagaaccattcattacctttaacttgaactccgttagaggttcccatttcttttacgaatttggtgatggtttcggtgttactgattcttggacaaaagttgacatgaagtccgttttgattgacccaattccattgggtgaagaatga

SEQ ID NO: 77 - DNA, 1710 bp, Artificial Sequence
  Santalene synthase SaSSy-33
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatggttctaatggttggtggtttggtcacttgcatgctacatccttgagattcagattattgagacaatgcggtttgttcatcccacaagatgttttcaagaccttccaatctaagaccgatgaattcgatatgaagttgtgcgataacatcaagggtttgttgtccttgtacgaagcttcatttttgggttggaagggtgaaaacatattggatgaagctaaagctttcgccactaagtacttgaaaaatgcctgggaaaacatttcccaaaagtggttggctaaaagagttaagcacgctttggctttgccattgcattggagagttccaagaattgaagctagatggttcattgaagcctacgaacaagaagaaaacatgaacccaactttgttgaaattggccaagttggatttcaacatggtccaatccatccaccaaaaagaaattggtgaattggcaagatggtgggttactactggtttggataagttggcttttgccagaaacaacttgttgcaatcttacatgtggtcttgcgctattgcttctgatccaaagtttaagttggccagagaaaccattgtcgaaatcggttctgttttgaccgttgttgatgatgcttatgatgtctacggttccatggatgaattggatcattacacctactctgtcgaaagatggtcttgtgtcgaaattgataagttgccaaacactttgaagttgatcttcatgtccatgttcaacaagaccaacgaagttggtttgagagttcaacacgaaagaggttataacggtattccaacctttattaaggcctgggttgaacaatgtaaggcctatcaaaaagaagccagatggtatcacggtggtcatactccaccattggaagaatattcattgaacggtttggtttccatcggtttccctttgttgttgattactggttacattgctatcgctgaaaacgaagctgctttggacaaagttcatccattgccagatttgttgcactactcatctttgttgtcaagattgatcaacgatatgggtacttctccagacgaaatggagagaggtgataacttgaaatctatccactgctacatgaacgaaactggtgcttctgaagaagttgctagagaacatattaagggtatcatcgaagaaaactggaagattttgaatcaatgctgcttcgaccaatctcaattccaagaaccattcattacctttaacttgaactccgttagaggttcccatttcttttacgaatttggtgatggtttcggtgttactgattcttggacaaaagttgacatgaagtccgttttgattgacccaattccattgggtgaagaatga

SEQ ID NO: 78 - DNA, 1710 bp, Artificial Sequence
  Santalene synthase SaSSy-34
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgccccaatggaaccattggctaagttggaattggttgacgttgttcaaagattgggtttgaaccacttgttcgaaaccgaaatcaaagaagccttgttctccatctacaaggatggttctaatggttggtggtttggtcacttgcatgctacatctttgagattcagattattgagacaatgcggtttgttcatcccacaagatgttttcaagaccttccaatctaagaccgatgaattcgatatgaagttgtgcgataacatcaagggtttgttgtccttgtacgaagcttcatttttgggttggaagggtgaaaacatattggatgaagctaaagctttcgccactaagtacttgaaaaatgcctgggaaaacatttcccaaaagtggttggctaaaagagttaagcacgctttggctttgccattgcattggagagttccaagaattgaagctagatggttcattgaagcctacgaacaagaagaaaacatgaacccaactttgttgaaattggccaagttggatttcaacatggtccaatccatccaccaaaaagaaattggtgaattggcaagatggtgggttactactggtttggataagttggcttttgccagaaacaacttgttgcaatcttacatgtggtcttgcgctattgcttctgatccaaagtttaagttggccagagaaaccattgtcgaaatcggttctgttttgaccgttgttgatgatgcttatgatgtctacggttccatggatgaattggatcattacacctactctgtcgaaagatggtcttgtgtcgaaattgataagttgccaaacactttgaagttgatcttcatgtccatgttcaacaagaccaacgaagttggtttgagagttcaacacgaaagaggttataacggtattccaacctttattaaggcctgggttgaacaatgtaaggcctatcaaaaagaagccagatggtatcacggtggtcatactccaccattggaagaatattcattgaacggtttggtttccatcggtttccctttgttgttgattactggttacattgctatcgctgaaaacgaagctgctttggacaaagttcatccattgccagatttgttgcactactcatctttgttgtcaagattgatcaacgatatgggtacttctccagacgaaatgctcagaggtgataacttgaaatctatccactgctacatgaacgaaactggtgcttctgaagaagttgctagagaacatattaagggtatcatcgaagaaaactggaagattttgaatcaatgctgcttcgaccaatctcaattccaagaaccattcattacctttaacttgaactccgttagaggttcccatttcttttacgaatttggtgatggtttcggtgttactgattcttggacaaaagttgacatgaagtccgttttgattgacccaattccattgggtgaagaatga

SEQ ID NO: 79 - DNA, 1710 bp, Artificial Sequence
  Santalene synthase SaSSy-35
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatggttctaatggttggtggtttggtcacttgcatgctacatccttgagattcagattattgagacaatgcggtttgttcatcccacaagatgttttcaagaccttccaatctaagaccgatgaattcgatatgaagttgtgcgataacatcaagggtttgttgtccttgtacgaagcttcatttttgggttggaagggtgaaaacatattggatgaagctaaagctttcgccactaagtacttgaaaaatgcctgggaaaacatttcccaaaagtggttggctaaaagagttaagcacgctttggctttgccattgcattggagagttccaagaattgaagctagatggttcattgaagcctacgaacaagaagaaaacatgaacccaactttgttgaaattggccaagttggatttcaacatggtccaatccatccaccaaaaagaaattggtgaattggcaagatggtgggttactactggtttggataagttggcttttgccagaaacaacttgttgcaatcttacatgtggtcttgcgctattgcttctgatccaaagtttaagttggccagagaaaccattgtcgaaatcggttctgttttgaccgttgttgatgatgcttatgatgtctacggttccatggatgaattggatcattacacctactctgtcgaaagatggtcttgtgtcgaaattgataagttgccaaacactttgaagttgatcttcatgtccatgttcaacaagaccaacgaagttggtttgagagttcaacacgaaagaggttataacggtattccaacctttattaaggcctgggttgaacaatgtaaggcctatcaaaaagaagccagatggtatcacggtggtcatactccaccattggaagaatattcattgaacggtttggtttccatcggtttccctttgttgttgattactggttacattgctatcgctgaaaacgaagctgctttggacaaagttcatccattgccagatttgttgcactactcatctttgttgtcaagattgatcaacgatatgggtacttctccagacgaaatggttagaggtgataacttgaaatctatccactgctacatgaacgaaactggtgcttctgaagaagttgctagagaacatattaagggtatcatcgaagaaaactggaagattttgaatcaatgctgcttcgaccaatctcaattccaagaaccattcattacctttaacttgaactccgttagaggttcccatttcttttacgaatttggtgatggtttcggtgttactgattcttggacaaaagttgacatgaagtccgttttgattgacccaattccattgggtgaagaatga

SEQ ID NO: 80 - DNA, 1710 bp, Artificial Sequence
  Santalene synthase SaSSy-36
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatggttctaatggttggtggtttggtcacttgcatgctacatccttgagattcagattattgagacaatgcggtttgttcatcccacaagatgttttcaagaccttccaatctaagaccgatgaattcgatatgaagttgtgcgataacatcaagggtttgttgtccttgtacgaagcttcatttttgggttggaagggtgaaaacatattggatgaagctaaagctttcgccactaagtacttgaaaaatgcctgggaaaacatttcccaaaagtggttggctaaaagagttaagcacgctttggctttgccattgcattggagagttccaagaattgaagctagatggttcattgaagcctacgaacaagaagaaaacatgaacccaactttgttgaaattggccaagttggatttcaacatggtccaatccatccaccaaaaagaaattggtgaattggcaagatggtgggttactactggtttggataagttggcttttgccagaaacaacttgttgcaatcttacatgtggtcttgcgctattgcttctgatccaaagtttaagttggccagagaaaccattgtcgaaatcggttctgttttgaccgttgttgatgatgcttatgatgtctacggttccatggatgaattggatcattacacctactctgtcgaaagatggtcttgtgtcgaaattgataagttgccaaacactttgaagttgatcttcatgtccatgttcgacaagaccaacgaagttggtttgagagttcaacacgaaagaggttataacggtattccaacctttattaaggcctgggttgaacaatgtaaggcctatcaaaaagaagccagatggtatcacggtggtcatactccaccattggaagaatattcattgaacggtttggtttccatcggtttccctttgttgttgattactggttacattgctatcgctgaaaacgaagctgctttggacaaagttcatccattgccagatttgttgcactactcatctttgttgtcaagattgatcaacgatatgggtacttctccagacgaaatggtaagaggtgataacttgaaatctatccactgctacatgaacgaaactggtgcttctgaagaagttgctagagaacatattaagggtatcatcgaagaaaactggaagattttgaatcaatgctgcttcgaccaatctcaattccaagaaccattcattacctttaacttgaactccgttagaggttcccatttcttttacgaatttggtgatggtttcggtgttactgattcttggacaaaagttgacatgaagtccgttttgattgacccaattccattgggtgaagaatga

SEQ ID NO: 81 - DNA, 1659 bp, Artificial Sequence
  Santalene synthase SaSSy-115
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaacgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 82 - DNA, 1659 bp, Artificial Sequence
  Santalene synthase SaSSy-38
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttggttaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgttgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 83 - DNA, 1659 bp, Artificial Sequence
  Santalene synthase SaSSy-39
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgttgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccactggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 84 - DNA, 1659 bp, Artificial Sequence
  Santalene synthase SaSSy-40
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttcccagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgttgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 85 - DNA, 1659 bp, Artificial Sequence
  Santalene synthase SaSSy-41
atggctccagctatcgttatgtctaactacgaagaagaagaaatcgttagaagaatgggcaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 86 - DNA, 1659 bp, Artificial Sequence
  Santalene synthase SaSSy-42
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaaccctatcccaacccttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 87 - DNA, 1704 bp, Artificial Sequence
  Santalene synthase SaSSy-43
atggactcttctactgctaccgctactactgctccttttattgatccaaccaatcacgtcaacttgaagatcgataacgattcctctgaaaacagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtagcatggatgaattggacttgtacacctcttctgttgaaagatggtcctgcgccgaaattgatctattgccacccaccttgaagttgatcttcatgtccatgttcaacaagactaacgaagttggtttgagagttcaacacgaaagaggttacaacggtattccaactttgattaaggcctgggttgaacaatgtaaggcctatcaaaaagaagccagatggtatcacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcaccgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 88 - DNA, 1605 bp, Artificial Sequence
  Santalene synthase SaSSy-44
atgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtagcatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaacggtattccaactttgattaaggcctgggttgaacaatgtaaggcctatcaaaaagaagccagatggtatcacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 89 - DNA, 1659 bp, Artificial Sequence
  Santalene synthase SaSSy-45
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaggcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttccgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 90 - DNA, 1659 bp, Artificial Sequence
  Santalene synthase SaSSy-46
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaagaaattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 91 - DNA, 1659 bp, Artificial Sequence
  Santalene synthase SaSSy-47
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgtataacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 92 - DNA, 1659 bp, Artificial Sequence
  Santalene synthase SaSSy-48
atggctccagctatcgttatgtctaactacgaagaaggagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 93 - DNA, 1659 bp, Artificial Sequence
  Santalene synthase SaSSy-116
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagagtcttgttgaaagaaaagatggaaccattggcccaattggaattggttgatgttgttcaaagattgggtttgaaccacttgttggaaaccgaaatcaaagaagccttgctctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttaattaacgacatccaaggtatgttgtccttgtacgaagcttcatttttgggttggaagggtgaaaacattctggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcctgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 94 - DNA, 1659 bp, Artificial Sequence
  Santalene synthase SaSSy-50
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaacagtggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 95 - DNA, 1659 bp, Artificial Sequence
  Santalene synthase SaSSy-51
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatctgtgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 96 - DNA, 1659 bp, Artificial Sequence
  Santalene synthase SaSSy-52
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgacccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 97 - DNA, 1659 bp, Artificial Sequence
  Santalene synthase SaSSy-53
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttcccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 98 - DNA, 1659 bp, Artificial Sequence
  Santalene synthase SaSSy-54, SaSSy-89
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggtggtcatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 99 - DNA, 1659 bp, Artificial Sequence
  Santalene synthase SaSSy-117
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactacaggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacagtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 100 - DNA, 1659 bp, Artificial Sequence
  Santalene synthase SaSSy-56
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgatcgacccaattccattaggtgaagaatga

SEQ ID NO: 101 - DNA, 1659 bp, Artificial Sequence
  Santalene synthase SaSSy-57
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaactgggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttctacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 102 - DNA, 1659 bp, Artificial Sequence
  Santalene synthase SaSSy-58
atggctccagctatcgttatgtctaactacgaagaagaagaaatcgttagaagaatgggtaactacaagccatccatttggaactatgacttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaacactggtcgtgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 103 - DNA, 1659 bp, Artificial Sequence
  Santalene synthase SaSSy-59
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaacttggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 104 - DNA, 1659 bp, Artificial Sequence
  Santalene synthase SaSSy-60
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagactcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 105 - DNA, 1659 bp, Artificial Sequence
  Santalene synthase SaSSy-61
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaaggggcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccccttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 106 - DNA, 1659 bp, Artificial Sequence
  Santalene synthase SaSSy-62
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgtcgaaagatggtcttgtgtcgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 107 - DNA, 1659 bp, Artificial Sequence
  Santalene synthase SaSSy-63
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgtcgaaagatggtctacggtcgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 108 - DNA, 1659 bp, Artificial Sequence
  Santalene synthase SaSSy-64
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgtcgaaagatggtctttggtcgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 109 - DNA, 1659 bp, Artificial Sequence
  Santalene synthase SaSSy-65
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagccaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgtcgaaagatggtctactgtcgaaattgataagttgccaaacaccttgaagttgatcttcatgtccatgttcaacaagactaacgaagttggtttgagagttcaacacgaaagaggttacaaccctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 110 - DNA, 1659 bp, Artificial Sequence
  Santalene synthase SaSSy-66
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgtcgaaagatggtctaccgtcgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgacaacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 111 - DNA, 1659 bp, Artificial Sequence
  Santalene synthase SaSSy-67
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgtcgaaagatggtctcctgtcgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 112 - DNA, 1659 bp, Artificial Sequence
  Santalene synthase SaSSy-68
atggctccagctatcgttatgtctaactacgaagaagaagaaatcgttagaagaatgggtaactacaagccatccatttggaactatgatttcttgcaatctctggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 113 - DNA, 1659 bp, Artificial Sequence
  Santalene synthase SaSSy-69
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccctgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 114 - DNA, 1659 bp, Artificial Sequence
  Santalene synthase SaSSy-70
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaactggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 115 - DNA, 1659 bp, Artificial Sequence
  Santalene synthase SaSSy-71
atggctccagctatcgttatgtctaactacgaggaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 116 - DNA, 1659 bp, Artificial Sequence
  Santalene synthase SaSSy-72
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccaactacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 117 - DNA, 1659 bp, Artificial Sequence
  Santalene synthase SaSSy-73
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggctttcgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 118 - DNA, 1659 bp, Artificial Sequence
  Santalene synthase SaSSy-74
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggtatcaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 119 - DNA, 1659 bp, Artificial Sequence
  Santalene synthase SaSSy-75
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgtcgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 120 - DNA, 1704 bp, Artificial Sequence
  Santalene synthase SaSSy-76
atggactcttctactgctaccgctactactgctccttttattgatccaaccaatcacgtcaacttgaagatcgataacgattcctctgaaaacagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtagcatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaacggtattccaactttgattaaggcctgggttgaacaatgtaaggcctatcaaaaagaagccagatggtatcacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 121 - DNA, 1659 bp, Artificial Sequence
  Santalene synthase SaSSy-77
atggctccagctatcgttatgtctaactacgaagaagaagaaatcgctagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaactggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 122 - DNA, 1659 bp, Artificial Sequence
  Santalene synthase SaSSy-78
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcaccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccggacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 123 - DNA, 1659 bp, Artificial Sequence
  Santalene synthase SaSSy-79
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccctattgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 124 - DNA, 1659 bp, Artificial Sequence
  Santalene synthase SaSSy-80
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcacaactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 125 - DNA, 1659 bp, Artificial Sequence
  Santalene synthase SaSSy-81
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcacgactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 126 - DNA, 1659 bp, Artificial Sequence
  Santalene synthase SaSSy-82
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggtggacatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 127 - DNA, 1659 bp, Artificial Sequence
  Santalene synthase SaSSy-83
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatccttgagattcagattattgagacaacaaggtatcaagatctcctgcgacgtttttgaacaattcaaggatgacgaaggtagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 128 - DNA, 1659 bp, Artificial Sequence
  Santalene synthase SaSSy-84
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttcacatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 129 - DNA, 1659 bp, Artificial Sequence
  Santalene synthase SaSSy-85
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggtcagcatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 130 - DNA, 1659 bp, Artificial Sequence
  Santalene synthase SaSSy-118
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaatggccaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 131 - protein, 568 aa, Artificial Sequence
  Santalene synthase SaSSy-1
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDHIDSDKADLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGSIDELDLYTSSVERWSCAEIDKLPNTLKLIFMSMFNKTNEVGLRVQHERGYNSIPTLIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 132 - protein, 569 aa, Artificial Sequence
  Santalene synthase SaSSy-2
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQSKTDEFDMKLCDNIKGLLSLYEASFLGWKGENILDEAKAFATKYLKNAWENISQKWLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGSMDELDHYTYSVERWSCVEIDKLPNTLKLIFMSMFNKTNEVGLRVQHERGYNGIPTFIKAWVEQCKAYQKEARWYHGGHTPPLEEYSLNGLVSIGFPLLLITGYIAIAENEAALDKVHPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 133 - protein, 552 aa, Artificial Sequence
  Santalene synthase SaSSy-3, SaSSy-39, SaSSy-40, SaSSy-62
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 134 - protein, 552 aa, Artificial Sequence
  Santalene synthase SaSSy-4
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGTMDELDHYTYSVERWSCVEIDKLPNTLKLIFMSMFNKTSEVGLRVQHERGYNGIPTLIKAWVEQCKAYQKEARWYHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 135 - protein, 567 aa, Artificial Sequence
  Santalene synthase SaSSy-5
MDSSTATATTAPFIDPTNHVNLKIDNDSSENRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGSMDELDLYTSSVERWSCVEIDKLPNTLKLIFMSMFNKTNEVGLRVQHERGYNGIPTLIKAWVEQCKAYQKEARWYHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 136 - protein, 552 aa, Artificial Sequence
  Santalene synthase SaSSy-6, SaSSy-41, SaSSy-52, SaSSy-56, SaSSy-61, SaSSy-68, SaSSy-69, SaSSy-70, SaSSy-71, SaSSy-73, SaSSy-75, SaSSy-79, SaSSy-87, SaSSy-88, SaSSy-114 and SaSSy-115
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 137 - protein, 569 aa, Artificial Sequence
  Santalene synthase SaSSy-7
MDSSTATAMTAPFIDPTDHVNLKTDTDASENRRMGNYKPSIWNYDFLQSLATHHNIVEERHLKLAEKLKGQVKFMFGEKMEPLAQLELVDVVQRLGLNHLFETEIKEALFSIYKDGSNGWWFGHLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 138 - protein, 569 aa, Artificial Sequence
  Santalene synthase SaSSy-8, SaSSy-9
MDSSTATAMTAPFIDPTDHVNLKTDTDASENRRMGNYKPSIWNYDFLQSLATHHNIVEERHLKLAEKLKGQVRILLKEKMEPLAKLELVDVVQRLGLNHLFETEIKEALFSIYKDGSNGWWFGHLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 139 - protein, 554 aa, Artificial Sequence
  Santalene synthase SaSSy-10
MAPAIVMSNYEEEEIVRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGFIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 140 - protein, 569 aa, Artificial Sequence
  Santalene synthase SaSSy-11, SaSSy-12
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGVAYHFETEIKEALFSIYKDGSNGWWFGHLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 141 - protein, 570 aa, Artificial Sequence
  Santalene synthase SaSSy-13
MDSSTATAMTAPFIDPTDHVNLKTDTDASENRRMGNYKPSIWNYDFLQSLATHHNIVEERHLKLAEKLKGQVEFMFGAPMEPLAKLELVDVVQRLGLNHLFETEIKEALFSIYKDFHDCNDMDGDLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 142 - protein, 573 aa, Artificial Sequence
  Santalene synthase SaSSy-14
MDSSTATAVTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDHKCFHNNEVEKMDLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 143 - protein, 569 aa, Artificial Sequence
  Santalene synthase SaSSy-15
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGSLEELQLFTQTIERWDINSLDKLPNTLKLIFMSMFNKTSEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 144 - protein, 568 aa, Artificial Sequence
  Santalene synthase SaSSy-16
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQNKTGEFDMKLCDNVKGLLSLYEASYLGWKGENILDEAKAFTTKCLKAMVESLGYHLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGSIDELDLYTSSVERWSCVEIDRLPDTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 145 - protein, 569 aa, Artificial Sequence
  Santalene synthase SaSSy-17
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLLETEIKEALFSIYKDGSNGWWFGHLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 146 - protein, 568 aa, Artificial Sequence
  Santalene synthase SaSSy-18
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDHIDSDKADLHATSLRFRLLRQCGLFIPQDVFKTFQNKTGEFDMKLCDNVKGLLSLYEASYLGWKGENILDEAKAFATKYLKNAWENISQKWLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGSMDELDHYTYSVERWSCAEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 147 - protein, 568 aa, Artificial Sequence
  Santalene synthase SaSSy-19
MDSSSATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDHIDSDKADLHATSLRFRLLRQCGLFIPQDVFKTFQNKTGEFDMKLCDNVKGLLSLYEASYLGWKGENILDEAKAFATKYLKNAWENISQKWLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGSMDELDHYTYSVERWSCAEIDKLPNTLKLIFMSMFNKTNEVGLRVQHERGYNGIPTLIKAWVEQCKAYQKEARWYHGGHTPPLEEYSLNGLVSIGFPLLLITGYIAIAENEAALDKVHPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 148 - protein, 568 aa, Artificial Sequence
  Santalene synthase SaSSy-20
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDHIDSDKADLHATSLRFRLLRQCGLFIPQDVFKTFQNKTGEFDMKLCDNVKGLLSLYEASHLGWKGENILDEAKAFATKYLKNAWENISQKWLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGSMDELDHYTYSVERWSCVEIDKLPNTLKLIFMSMFNKTNEVGLRVQHERGYNGIPTFIKAWVEQCKAYQKEARWYHGGHTPPLEEYSLNGLVSIGFPLLLITGYIAIAENEAALDKVHPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 149 - protein, 568 aa, Artificial Sequence
  Santalene synthase SaSSy-21
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDHIDSDKADLHATSLRFRLLRQCGLFIPQDVFKTFQNKTGEFDMKLCDNVKGLLSLYEASYLGWKGENILDEAKAFATKYLKNAWENISQKWLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGSMDELDHYTYSVERWSCVEIDKLPNTLKLIFMSMFNKTNEVGLRVQHERGYNGIPTFIKAWVEQCKAYQKEARWYHGGHTPPLEEYSLNGLVSIGFPLLLITGYIAIAENEAALDKVHPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 150 - protein, 569 aa, Artificial Sequence
  Santalene synthase SaSSy-22
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFEKEIEDAIQQLCPIGSNGWWFGHLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 151 - protein, 569 aa, Artificial Sequence
  Santalene synthase SaSSy-23
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQQGIKISCDVFEQFKDDEGRFKSSLINDVQGMLSLYEASYLGWKGENILDEAKAFATKYLKNAWENISQKWLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGSMDELDHYTYSVERWSCVEIDKLPNTLKLIFMSMFNKTNEVGLRVQHERGYNGIPTFIKAWVEQCKAYQKEARWYHGGHTPPLEEYSLNGLVSIGFPLLLITGYIAIAENEAALDKVHPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 152 - protein, 569 aa, Artificial Sequence
  Santalene synthase SaSSy-24
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQQGIKISCDVFEQFKDDEGRFKSSLINDVQGMLSLYEASYLGWKGENILDEAKAFATKYLKNAWENISQKWLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGSMDELDHYTYSVERWSCVEIDKLPNTLKLIFMSMFNKTNEVGLRVQHERGYNGIPTFIKAWVEQCKAYQKEARWYHGGHTPPLEEYSLNGLVSIGFPLLLITGYIAIAENEAALDKVHPLPDLLHYSSLLSRLINDMGTSPDEMARGDNLKSIHCYMNETGASEEVAREHIKGIIEENWKILNQCCFDQSQFREPFITFNLNSVRGSHFFYEFGDGFGVTDSWTKVDMKSVLIDPIPLGEE

SEQ ID NO: 153 - protein, 569 aa, Artificial Sequence
  Santalene synthase SaSSy-25
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQHGHHVPQEVFCSFMDDVGNFRAWLCEDVRGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 154 - protein, 569 aa, Artificial Sequence
  Santalene synthase SaSSy-26
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQQGIKISCDVFEQFKDDEGRFKSSLINDVQGMLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 155 - protein, 569 aa, Artificial Sequence
  Santalene synthase SaSSy-27
MDSSTATATTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHRKEIGELARWWVTTGLDKLAFARNNLLQSYMWSCAIASDPKFKLARETIVEIGSVLTVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 156 - protein, 569 aa, Artificial Sequence
  Santalene synthase SaSSy-28, SaSSy-32
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQSKTDEFDMKLCDNIKGLLSLYEASFLGWKGENILDEAKAFATKYLKNAWENISQKWLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGSMDELDHYTYSVERWSCVEIDKLPNTLKLIFMSMFNKTNEVGLRVQHERGYNGIPTFIKAWVEQCKAYQKEARWYHGGHTPPLEEYSLNGLVSIGFPLLLITGYIAIAENEAALDKVHPLPDLLHYSSLLSRLINDMGTSPDEMPRGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 157 - protein, 569 aa, Artificial Sequence
  Santalene synthase SaSSy-29
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQSKTDEFDMKLCDNIKGLLSLYEASFLGWKGENILDEAKAFATKYLKNAWENISQKWLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGLMDELDHYTYSVERWSCVEIDKLPNTLKLIFMSMFNKTNEVGLRVQHERGYNGIPTFIKAWVEQCKAYQKEARWYHGGHTPPLEEYSLNGLVSIGFPLLLITGYIAIAENEAALDKVHPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 158 - protein, 569 aa, Artificial Sequence
  Santalene synthase SaSSy-30
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQSKTDEFDMKLCDNIKGLLSLYEASFLGWKGENILDEAKAFATKYLKNAWENISQKWLAKRVKHALALPLHWRVPRIEARWFIEAYEQEENMNPTLLKLAKLDFSMVQSIHQKEIGELARWWVTTGLDKLAFARNNLLQSYMWSCAIASDPKFKLARETIVEIGSVLTVVDDAYDVYGSMDELDHYTYSVERWSCVEIDKLPNTLKLIFMSMFNKTNEVGLRVQHERGYNGIPTLIKAWVEQCKAYQKEARWYHGGHTPPLEEYSLNGLVSIGFPLLLITGYIAIAENEAALDKVHPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 159 - protein, 569 aa, Artificial Sequence
  Santalene synthase SaSSy-31
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQSKTDEFDMKLCDNIKGLLSLYEASFLGWKGENILDEAKAFATKYLKNAWENISQKWLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGSMDELDHYTYSVERWSCVEIDKLPNTLKLIFMSMFNKTNEVGLRVQHERGYNGIPTLIKAWVEQCKAYQKEARWYHGGHTPPLEEYSLNGLVSIGFPLLLITGYIAIAENEAALDKVHPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 160 - protein, 569 aa, Artificial Sequence
  Santalene synthase SaSSy-33
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQSKTDEFDMKLCDNIKGLLSLYEASFLGWKGENILDEAKAFATKYLKNAWENISQKWLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGSMDELDHYTYSVERWSCVEIDKLPNTLKLIFMSMFNKTNEVGLRVQHERGYNGIPTFIKAWVEQCKAYQKEARWYHGGHTPPLEEYSLNGLVSIGFPLLLITGYIAIAENEAALDKVHPLPDLLHYSSLLSRLINDMGTSPDEMERGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 161 - protein, 569 aa, Artificial Sequence
  Santalene synthase SaSSy-34
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQSKTDEFDMKLCDNIKGLLSLYEASFLGWKGENILDEAKAFATKYLKNAWENISQKWLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGSMDELDHYTYSVERWSCVEIDKLPNTLKLIFMSMFNKTNEVGLRVQHERGYNGIPTFIKAWVEQCKAYQKEARWYHGGHTPPLEEYSLNGLVSIGFPLLLITGYIAIAENEAALDKVHPLPDLLHYSSLLSRLINDMGTSPDEMLRGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 162 - protein, 569 aa, Artificial Sequence
  Santalene synthase SaSSy-35
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQSKTDEFDMKLCDNIKGLLSLYEASFLGWKGENILDEAKAFATKYLKNAWENISQKWLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGSMDELDHYTYSVERWSCVEIDKLPNTLKLIFMSMFNKTNEVGLRVQHERGYNGIPTFIKAWVEQCKAYQKEARWYHGGHTPPLEEYSLNGLVSIGFPLLLITGYIAIAENEAALDKVHPLPDLLHYSSLLSRLINDMGTSPDEMVRGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 163 - protein, 569 aa, Artificial Sequence
  Santalene synthase SaSSy-36
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFIPQDVFKTFQSKTDEFDMKLCDNIKGLLSLYEASFLGWKGENILDEAKAFATKYLKNAWENISQKWLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGSMDELDHYTYSVERWSCVEIDKLPNTLKLIFMSMFDKTNEVGLRVQHERGYNGIPTFIKAWVEQCKAYQKEARWYHGGHTPPLEEYSLNGLVSIGFPLLLITGYIAIAENEAALDKVHPLPDLLHYSSLLSRLINDMGTSPDEMVRGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 164 - protein, 552 aa, Artificial Sequence
  Santalene synthase SaSSy-116
MAPAIVMSNYEEEEIVRRMGNYKPSIWNYDFLQSLATHHNIVEERHLKLAEKLKGQVRVLLKEKMEPLAQLELVDVVQRLGLNHLLETEIKEALLSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 165 - protein, 552 aa, Artificial Sequence
  Santalene synthase SaSSy-38
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLVNDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 166 - protein, 552 aa, Artificial Sequence
  Santalene synthase SaSSy-42
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNPIPTLIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 167 - protein, 567 aa, Artificial Sequence
  Santalene synthase SaSSy-43
MDSSTATATTAPFIDPTNHVNLKIDNDSSENRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGSMDELDLYTSSVERWSCAEIDLLPPTLKLIFMSMFNKTNEVGLRVQHERGYNGIPTLIKAWVEQCKAYQKEARWYHGGHTPPLEEYSLNGLVSIGFPLLLITGYIAIAENEAALDKVRPLPDLLHYSSLLSRLINDMGTSPDEMARGDNLKSIHRYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 168 - protein, 534 aa, Artificial Sequence
  Santalene synthase SaSSy-44
MGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGSMDELDLYTSSVERWSCAEIDRLPDTLKLIFMSMFNKTNEVGLRVQHERGYNGIPTLIKAWVEQCKAYQKEARWYHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 169 - protein, 552 aa, Artificial Sequence
  Santalene synthase SaSSy-45
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVRHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 170 - protein, 552 aa, Artificial Sequence
  Santalene synthase SaSSy-46
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGEEILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 171 - protein, 552 aa, Artificial Sequence
  Santalene synthase SaSSy-47
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMYNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 172 - protein, 552 aa, Artificial Sequence
  Santalene synthase SaSSy-48
MAPAIVMSNYEEGEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 173 - protein, 9 aa, Artificial Sequence
  aspartate rich region
  VARIANT 1: Xaa = Asn or Asp
  VARIANT 2, 3, 4, 6, 7, 8: Xaa = any amino acid
  VARIANT 5: Xaa = Ser or Thr
XXXXXXXXE

SEQ ID NO: 174 - protein, 552 aa, Artificial Sequence
  Santalene synthase SaSSy-50
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVEQWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 175 - protein, 552 aa, Artificial Sequence
  Santalene synthase SaSSy-51
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAICENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 176 - DNA, 1029 bp, Santalum album
  Farnesyl diphosphate synthase (SaFPPS)
atgggcgatcggaaaaccaaatttctcgaggcctactctgtcttgaaatcggagctcctccgggaccctgctttcaattttacagacgcttcccgtcaatgggtcgaccggatgctggactacaatgtgcctggagggaaactgaatcgagggctctcagtgattgacagctatgagttgctgaaagaaggaaaagagctaactgatgatgaaatatttcttgcatctgcactcggttggtgcattgaatggcttcaagcatattttcttgttctcgatgatattatggatggctctcatacacgccgaggtcagccttgttggttcaggttgcctgaggttggtctgattgctgtaaatgatggcataatgcttcgcaaccacatcccaagaattctcaagaagcacttcaaaaataagccttattatgtggaactgttggatttatttaatgaggtcgagttccaaacaacttcaggacagatgatagatttgataaccacgcttgaagggcagaaagatctttcaaagtattcaatgcctattcaccatcgcattgttcagtataaaactgcttattactccttttaccttccggttgcttgtgcactgcttatgtcaggtgagaatctggacagccacactgaagtggagaaaatccttgttgaaatgggaacctattttcaagtacaggatgattacctggactgctttggtcatcctgatgtcattggaaagattggaacagatattgaagattttaagtgttcttggttggttgtaaaagcgttggaactttccaacgaggaacagaagaaattattatatgagaactatgggaaagccgatgaagccagcgttgcaaaagtaaaggcactttataaggaacttgaccttgagggtgcatttgtggagtacgagaatgctagttatgagaagataatcagctcaattgaggtgcagccaagcaaagcagtacaagcagtgctgaaatcctttttggcgaagatatacaagcggcagaagtag

SEQ ID NO: 177 - protein, 552 aa, Artificial Sequence
  Santalene synthase SaSSy-53, SaSSy-84, SaSSy-91, SaSSy-97
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGSHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 178 - protein, 552 aa, Artificial Sequence
  Santalene synthase SaSSy-54, SaSSy-82, SaSSy-89
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGGHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 179 - protein, 552 aa, Artificial Sequence
  Santalene synthase SaSSy-55, SaSSy-101
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGTHLAKRVKHALALPLHWRVPRIEARWFIEAYEQEENMNPTLLKLAKLDFNMVQSIHQKEIGELARWWVTTGLDKLAWARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 180 - protein, 552 aa, Artificial Sequence
  Santalene synthase SaSSy-102
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAWARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 181 - protein, 552 aa, Artificial Sequence
  Santalene synthase SaSSy-57
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVELGSVLTVVDDAYDVYGHMDELDLYTSSVERWSCAEIDRLPDTLKLIFMSMFNKTNEVGLRVQHERGYNSIPTFIKAWVEQCKSYQKEARWFYGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 182 - protein, 552 aa, Artificial Sequence
  Santalene synthase SaSSy-58
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVEHWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 183 - protein, 552 aa, Artificial Sequence
  Santalene synthase SaSSy-59
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVETWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 184 - protein, 552 aa, Artificial Sequence
  Santalene synthase SaSSy-60
MAPAIVMSNYEEEEIVRRMGNYKPSIWNYDFLQSLATHHNIVEERHLKLAEKLKTQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 185 - protein, 552 aa, Artificial Sequence
  Santalene synthase SaSSy-63, SaSSy-66
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSTVEIDKLPNTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 186 - protein, 552 aa, Artificial Sequence
  Santalene synthase SaSSy-64
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSLVEIDKLPNTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 187 - protein, 552 aa, Artificial Sequence
  Santalene synthase SaSSy-65
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSTVEIDKLPNTLKLIFMSMFNKTNEVGLRVQHERGYNPIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 188 - protein, 552 aa, Artificial Sequence
  Santalene synthase SaSSy-67
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSPVEIDKLPNTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 189 - protein, 552 aa, Artificial Sequence
  Santalene synthase SaSSy-72
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSNYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 190 - protein, 552 aa, Artificial Sequence
  Santalene synthase SaSSy-74
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGINSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 191 - protein, 567 aa, Artificial Sequence
  Santalene synthase SaSSy-76
MDSSTATATTAPFIDPTNHVNLKIDNDSSENRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGSMDELDLYTSSVERWSCAEIDRLPDTLKLIFMSMFNKTNEVGLRVQHERGYNGIPTLIKAWVEQCKAYQKEARWYHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 192 - protein, 552 aa, Artificial Sequence
  Santalene synthase SaSSy-77
MAPAIVMSNYEEEEIARRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 193 - protein, 552 aa, Artificial Sequence
  Santalene synthase SaSSy-78, SaSSy-80, SaSSy-81
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFTTKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 194 - protein, 552 aa, Artificial Sequence
  Santalene synthase SaSSy-83
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEGRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 195 - protein, 552 aa, Artificial Sequence
  Santalene synthase SaSSy-85
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGQHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 196 - protein, 552 aa, Artificial Sequence
  Santalene synthase SaSSy-117
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHSGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 197 - DNA, 1856 bp, Hyoscyamus muticus
  Vetispiradiene synthase
atggccccagctatagtgatgagtaactacgaagaggaggagattgttcgccctgttgcagatttttctccaagtctttggggtgatcatttccattcattctcagttgacaatcaggttgcggaaaagtatgctcaagagattgaaactttgaaggaacaaacaagtactatgttgtctgctgcttgtggaacaacattgactgagaaattgaatttgatagatattattgagcgccttggaatagcttatcatttcgagaaacaaatagaagatatgttggatcacatttacagagctgatccttattttgaggctcatgaatacaatgatttaaacacttcatccgttcaatttcgactactcagacaacatggttacaacgtctctccaaatatatttagcagattccaagatgcaaatggcaaattcaaggagtctcttagaagcgacatcaggggcctactgaacttatacgaagcttcacatgtaaggactcataaagaggatattttggaagaagcacttgttttttctgttggtcatcttgaatctgcagctccacatttgaagtcacctctgagtaagcaagtgacacatgccctcgaacaatctctccataagagcattccaagagtcgagatacggtacttcatctccatctacgaagaggaggaatttaagaatgatttgttgcttcgatttgctaaattggattacaacttacttcagatgttgcacaagcatgaactcagtgaagtatcaaggtggtggaaagatttggatttcgtgacaacacttccatatgctagggacagagcagttgagtgctacttttggacgatgggggtgtatgctgaacctcaatactcccaggctcgtgtcatgcttgctaagactatagcaatgatttccatagtagatgacacattcgatgcttatggcatcgtaaaagaacttgaagtctacacagatgccatacagaggtgggatattagtcaaattgatcgactcccggaatatatgaaaatcagttataaggctcttttggatctctatgacgattatgaaaaggagttgtcaaaggatggtagatccgatgttgtccactatgcaaaagaaagaatgaaggagattgtgggaaactattttattgaaggaaaatggtttattgagggatatatgccatctgtttccgagtaccttagcaatgcactagctactagcacatattacttgctaactacgacatcctacttgggaatgaaatcagcaaccaaggaacattttgaatggttggctacgaaccctaaaattctggaagctaatgctacattatgccgagttgttgatgacatagccacgtatgaggttgagaagggtaggggtcaaattgcaacaggaattgagtgttatatgagggattacggtgtatccacagaagtagcaatggagaaattccaagaaatggctgacatagcatggaaggatgtaaatgaagaaattcttcgaccaacacctgtctcttcagaaattcttactcgtattctcaacctggctcgaattatagatgtcacttacaagcataatcaagatggatacactcatcctgaaaaagtactaaaacctcacatcatcgccttggtggtggattctattgatatttgaatcaccaattgttgtgtacacctgggagcacttggttcccaccccctcaaataagtttttgacagacacttgatggatggtatctctgttgctaggtatacatgttgtaatcgtgcagtgaagttacgtccttaattcttttgtatgattatttacatttgaaatataataattctgctttttaacta

SEQ ID NO: 198 - DNA, 2024 bp, Salvia officinalis
  Bornyl diphosphate synthase
  CDS (11)...(1807): (+)-bornyl diphosphate synthase coding sequence
  ref <308>: DATABASE ACCESSION NUMBER: Genbank AF051900.1
  ref <309>: DATABASE ENTRY DATE: 1998-07-11
gatcacaaaaatgtctatcattagcatgaacgtatcgatccttagcaagccactaaattgcctccacaacttggagaggagaccttcaaaagccttgcttgtcccttgcactgcacccaccgctcgcctccgggcatcttgctcctcaaaactacaagaagctcatcaaatccgacgatctggaaactaccaacctgccctttgggattccaattacattcagtctctcaatactccatatacggaggagaggcacttggatagaaaagcagagctgattgtgcaagtgaggatactgctaaaggaaaaaatggagcctgttcaacaattggagttgattcatgacttgaaatatttggggctctcggatttttttcaagatgagattaaggagatcttaggtgttatatacaatgagcacaaatgctttcacaataatgaagtagagaaaatggatttgtatttcacagctcttggattcagactcctcagacaacatggttttaatatttcccaagatgtatttaattgtttcaagaacgagaagggtattgatttcaaggcaagccttgctcaagatacgaagggaatgttacaactgtatgaagcgtctttccttttgagaaaaggtgaagatacattggagcttgcaagagaatttgccacaaaatgtctgcagaaaaaacttgatgaaggtggtaatgaaattgatgagaatctattattgtggattcgccactctttggatcttcctctccactggaggattcaaagtgtagaggcaagatggttcatagatgcttatgcgagaaggccagacatgaatccacttattttcgagcttgccaaactcaacttcaatattattcaagcaacacatcaacaagaactgaaagatctctcgaggtggtggagtagattatgcttccctgaaaagctcccatttgtgagggataggctcgttgaatccttcttttgggcggttgggatgtttgagccacatcaacatggatatcagagaaaaatggccgccacaattattgttttagcaacagttatagatgatatttacgatgtgtatggtacactagatgaactagaactatttacagacacgtttaagagatgggatactgaatcaataacccgacttccttattacatgcaattatgttattggggtgtccacaactatatttccgatgcagcatatgatattctcaaagaacatggtttcttttgtctccaatatctccggaaatcggtggtagatttggttgaagcatattttcacgaggcaaagtggtaccacagcggttatacaccaagcctggatgaatatctcaacatcgccaagatttcagtggcgtctcctgcaataatatccccaacctatttcacattcgcaaacgcgtctcatgacacagcagtcatcgacagcttgtaccaatatcatgacatactttgcctagcaggaattattttgaggcttcccgacgatcttgggacatcatattttgagctggcgagaggcgacgtgccgaaaacaatccagtgctacatgaaggaaacaaatgctagtgaggaggaggcggtggagcacgtgaagtttctgataagggaggcgtggaaggatatgaacacggccatagcagccggttatccgtttccggatggtatggtggcgggcgcagctaatattgggcgcgtggcgcagtttatttatctccacggagatgggtttggcgtgcaacactcgaaaacgtacgagcatatcgccggcctactgttcgagccttatgcatgaacaaatgggagactgcttgatatatattaatttggcacaccaataattgcatgttatatatgttggaaaataagtgtctggttgagatgtcatgtggtgtattatctaaataattcaaggttgccttgtttatgtagccggtggtgcaactacctcccattcaaatcaattaaatctaaacagtcgagtcaagctcgagctcgaggaaaaaaaaaaa

SEQ ID NO: 199 - DNA, 1647 bp, Artificial Sequence
  Citrus valencene synthase V19
atgtcatctggtgaaacttttagaccaactgctgattttcatccatctttgtggagaaatcattttttgcaaggtgcatcagattttaagactgttgatcatacagctacaaatgaaagacatgaagctttgaaggaagaagttagaagaatgattactgatgcagaagatcaaccaattcaaaaattgagattgattgatgaagttcaaagattgggtgttgcttaccattttgaaaaagaaattgaagatgctattcaacaattgtgtccaattcatattgattctgataaagctgatttgcatactgtttctttgcatttcagattgttgagacaacaaggtattaagatttcttgtgatgttttcgaacaatttaaggatgatgaaggtagattcaaaagttctttgattaatgatgttcaaggcatgttgtctttgtatgaagctgcttatatggctgttagaggtgaacatattttggatgaagctattgcatttactactactcatttgcaatcattggttgcacaagatcatgttactccaagattggctgaacaaattaaccatgctttgtatagaccattgagaaaaactttgccaagattggaagcaagatacattatgtcaagaattgattctacttctgatgatttggttaacaagactttgttaaatttcgctaagttggatttcaatattttgttggatttgcataaagaagaattgaacgaattgactaaatggtggcaagatttggattttactactaaattgccatatgctagagatagattggttgaattgtacttttgggatttgggtacttattttgaaccacaatacgcttttggtagaaaaatcatgactaaattgaactacattttgtccattattgatgatacctacgatgcttacggtactttggaagaattgtctttgttcaccgaagctgttgctcgttggaacattgaagctgttgacatgttgccagattatatgaagttaatctacagaactttgttggatacattcaacgaaatagaagaggatatggctaaacaaggtagatctcattgtgtaagatacgctaaagaagaaattcaaaaggttattggtgcttattacgttcaagctaagtggttttctgaaggttatgtccctactattgaagaatacatgccaattgctttgacttcttgcgcttacagatttgttattaccaattcttttttgggtatgggtgatttcgctacaaaggaagtattcgaatggatttctggtaatccaaaagttgttaaatctgcttctgttatttgtagattgatggacgatatgcaaggacacgaatttgaacaaaaaagaggtcacgttgcatctgcaattgaatgctatactaaacaacatggtgtttccaaggaagaggctatcaagatgttcgaggaagaggttgctaacgcttggaaggatatcaatgaagaattaatgatgaaaccaccagttgttgctagaccattgttaggtactattttgaatttggctagagctatcgattttatctataaagaagatgacggttacactcattcttatttgattaaggaacaaatagcatctgttttgggtgatcatgttccattttaa

SEQ ID NO: 200 - DNA, 1671 bp, Vitis vinifera
  Valencene synthase
atgtctactcaagtctcagcatcttctctagcccagattccccaacccaaaaatcgtcctgtggcaaactttcaccccaacatttggggtgaccaatttatcacctacactcctgaagacaaggttactcgtgcctgcaaagaggagcagattgaggatctgaaaaaggaagtgaaaaggaaattaacggctgctgctgttgctaacccttcccaattgctgaacttcattgatgcagtgcaacgtcttggggtggcataccactttgagcaagagatagaagaagcattacaacatatttgtaatagttttcatgactgcaatgatatggatggtgatctctacaatattgctcttggatttcgactactaaggcaacaagggtacactatttcatgtgatatattcaacaagtttacggatgaacgaggtagattcaaggaagctttgatcagcgatgtaagaggcatgctaggcttgtatgaagctgcacatctgagggttcatggagaggacatacttgcaaaagcacttgctttcaccaccactcatctcaaggccatggtagaaagtttaggatatcatcttgcagaacaagttgctcatgccctgaaccggcccattagaaaaggtttggagaggctagaggcaagatggtatatatctgtctaccaagatgaagctttccatgataaaactttactagagctagcaaaattagatttcaatctagtgcagtcactgcacaaggaagagctaagcaatcttgcaaggtggtggaaagaattagactttgctacaaagttaccttttgcacgagacagattggttgaaggctacttttggatgcatggggtgtattttgagccccaatacttacggggtagacgaattctaaccaaagtaattgccatgacatccattctagatgatatccatgatgcatatggcacacctgaagaactcaagctcttcatagaagccattgagagatgggatattaacagcataaatcagcttccagaatacatgaaactctgctatgtggcactcttagatgtgtacaaagaaatcgaggaagagatggagaaagaaggaaaccaatatcgggttcactatgccaaagaagtaatgaagaatcaagttcgagcttactttgccgaggccaaatggttacatgaagaacacgtaccagcatttgaagagtacatgcgtgttgcactagcaagctctggatactgcctgcttgcaaccacgtcctttgtgggaatgggagaaatagcaacaaaggaggcctttgattgggtgaccagcgatcctaagattatgtcatcttcaaatttcattacgaggctcatggatgacatcaaatcacataagtttgagcaaaagagagggcatgtggcctcagctgttgaatgttacatgaagcaatatggtgtctctgaggaacaagtatacagtgaatttcaaaagcaaattgagaatgcatggctggatattaaccaggaatgcctcaaacctactgctgtttcaatgcctctccttgctcgtcttctcaatcttacacgaaccatggatgtcatttacaaagagcaagattcgtacacacatgttgggaaagtgatgagggataacattgcgtctgtcttcatcaacgctgtaatataa

SEQ ID NO: 201 - DNA, 1626 bp, Salvia sclarea
  Bergamotene synthase
atggaggagctgagaaggtcagcaaactttgaagccagtatctgggatgacgattacattcagtccctcacaagttcatatgcggggggaaactacgtaggtgaggctgagaagctgaaagatctggtgaaaataatgatagacgaaacggaagacgtggtgaaccaacttgagcttatcgacaatctgcagaggttgggtttatctcaccacttggagttggaggatcgcattgcaaaaatgttacacaacatttatgaaaatttccaacacatggaaaaggacttgtacgtcacagctctcggattcagacttctcagacaacatggacatcatgttcctcaagaggctttctgcagtttcatggacgatgtaagaaatttcagggcgtggctgtgtgaagacgtgagagggctgctatcgttgtacgaagcttcgtatttatccgcggaaggggaaagcatactggacttggccaaagatttctcacgggatcatcttggtcgagggctggaccacattacagaggtgcacgtagccgagcgagtgaggcatgctttggagctgcctctgcactggagaatggggagactagaagccaggtggttcatacaagcttatgagaatacatctgaagcaaaccttattctggtggagctatctaagttggacttcaacatggttcaggcaacgtaccaggaagagctcaagcgcatgtcaaggtggtataaagaaagtggtctgccggagaagttgggatttgcaaggcaccgactggcagagtgtttcttgtgggctatgggatttgtcccggagcgtcagcatggatattcgagggaggttttggtcaagattgcggtgttgatcacaatcatggatgacatatacgacgtgtatggatccttggaagaactccaattgttcactcaaacaatcgagaggtgggatattaattctctggacagccttcctgaatatatgaggattttcttcttagctctcttcaactccgccaacgagttggcttatgatattctgagggaccaaggtttcaacgttatctcaaatttgaggaaactgtggacacagctgagtagggcttactacttagaagcgaaatggtttcacagtggatatgtcccaaccacggatgagtacctaaaacaagcatggatttccatttcgggtcctctgcttctgttttatgcttacttcaccacaaatcctatatgcaacaaggaactgcacatgttggagcaatatcctggtatcattcgttggccatccacggttcttcgtttggcggatgacttgggaacttcatctgatgaaatgaaacgaggggacgttccgaaatcagtgcagtgctacatgaaggaaacaggatgctccgaggaggatgctcggaagcacgtgaagcaattgatggaggcagcattgaagcgaatgaacaaagagatagtaatggagaagcccttgaagaattttggtgacactgccatgaatcttggacgaatttcactctgcttttatcaacatggggatggcttcggccttccccactctcaaacaaagcaaaatatggtctcgctccttgttcaacccttccctatgcatcttaattaa

SEQ ID NO: 202 - protein, 16 aa, Hyoscyamus muticus
  Vetispiradiene synthase amino acids 1-16
MAPAIVMSNYEEEEIV

SEQ ID NO: 203 - protein, 7 aa, Salvia officinalis
  Bornyl diphosphate synthase amino acids 94-100
RILLKEK

SEQ ID NO: 204 - protein, 4 aa, Salvia officinalis
  Bornyl diphosphate synthase amino acids 99-102
EKME

SEQ ID NO: 205 - protein, 4 aa, Artificial Sequence
  Citrus valencene synthase V19 amino acids 74-77
VAYH

SEQ ID NO: 206 - protein, 13 aa, Artificial Sequence
  Citrus valencene synthase V19 amino acids 80-92
KEIEDAIQQLCPI

SEQ ID NO: 207 - protein, 8 aa, Artificial Sequence
  Citrus valencene synthase V19 amino acids 93-100
HIDSDKAD

SEQ ID NO: 208 - protein, 10 aa, Vitis vinifera
  Valencene synthase amino acids 104-113
FHDCNDMDGD

SEQ ID NO: 209 - protein, 13 aa, Salvia officinalis
  Bornyl diphosphate synthase amino acids 137-149
HKCFHNNEVEKMD

SEQ ID NO: 210 - protein, 29 aa, Salvia sclarea
  Bergamotene synthase amino acids 109-136
HGHHVPQEAFCSFMDDVRNFRAWLCEDVR

SEQ ID NO: 211 - protein, 31 aa, Artificial Sequence
  Citrus valencene synthase V19 amino acids  114-144
QGIKISCDVFEQFKDDEGRFKSSLINDVQGM

SEQ ID NO: 212 - protein, 31 aa, Artificial Sequence
  Citrus valencene synthase V19 amino acids  114-144 with two amino acid modifications
QGIKISCDVFEQFKDDEDRFKSSLINDIQGM

SEQ ID NO: 213 - protein, 9 aa, Vitis vinifera
  Valencene synthase amino acids  187-195
AMVESLGYH

SEQ ID NO: 214 - protein, 19 aa, Salvia sclarea
  Bergamotene synthase amino acids 302-320
LEELQLFTQTIERWDINSL

SEQ ID NO: 215 - protein, 29 aa, Salvia sclarea
  Bergamotene synthase amino acids 109-136 with two amino acid modifications
HGHHVPQEVFCSFMDDVGNFRAWLCEDVR

SEQ ID NO: 216 - DNA, 1401 bp, Nicotiana tabacum
  5-epi-aristolochene synthase
atggcctcagcagcagttggcaactatgaagaagagattgttcgccccgtcgccgacttctcccctagtctctggggtgatcagttcctttcattctccattaaaaatcaggttgcagaaaagtatgctaaagagattgaagcattgaaggaacaaacgaggaatatgctgttagcaactggaatgaaattggctgatacactgaatttgattgacattattgaacgtcttggcatctcctaccactttgaaaaagaaattgatgagattttggatcaaatttataaccaaaactcaaactgcgacgatttgtgcatttctgcacttcaatttcgattgctcaggcaacatggtttcaacatctctcctgaaattttcagcaaattccaagatgaaaatggcaaattcaaggagtctcttgctagtgatgtcttaggattattgaacttgtatgaagcttcacatgtaaggactcatgctgacgatatcttagaagacgcacttgctttctccactatccatcttgaatctgcagctccacatttgaaatctccacttaaggagcaagtgacacatgcccttgagcaatgtttgcacaagggtgttcctagagtcgagacccgattcttcatctcatcaatctatgacaaggaacaatcgaagaataatgtgttacttcgatttgccaaattggatttcaacttgctccagatgttgcacaaacaagaacttgctcaagtatcaaggtggtggaaagatttggatttcgtaacgacactgccatatgctagagatcgagtagttgaatgttacttttgggcattaggagtttattttgagcctcaatactctcaagcacgtgtcatgctcgttaagacaatatcgatgatttcgattgtcgatgacacctttgatgcttacggtacagttaaagaacttgaggcattcacagatcccatacaaagatgggatatcaacgaaattgatcggcttcctgattacatgaaaatcagttataaagctattctagatcttttcaaagattatgaaaaggaattgtctagtgctggaagatctcatattgttttccatgcaatagaaagagttgagaaaagtaggggacaaattgcaacaggcattgagtgctgcatgagagattatggcataacaacaaaagaggcaatgactaaatttcaagaaatggctgaggcagcatggaaggatcttaatgaaggacttcttaggcccactcctgtcgctacggaatttttatctcgtattctcaatcttgcccgtattgttgaggttacttatatacacaatctagatggatacactcatccggagaaagtcttgaaacctcacatcaatgccctacttgtggactctatcgatatttga

SEQ ID NO: 217 - DNA, 1749 bp, Artificial Sequence
  germacrene A synthase
atggccttggttagaaacaattcttctaatggtagagaaccaattttgtctccaagatctttgacttctccaagaggtttaacatctccaagaccattgactgttcaaccaactcaagaaccagttagaccattggctaattttccaccatctatttgggctgatagattcatttctttctcattggataacaatgaattggaagcttatgctaatgctttggaaggtccaaaagaagctgttagaaacttgattactgatactacttttgatgctactgctaagttgaaattgatttactccgttcatagattgggtttgtcttatttgtatccagaagaaattgatactgaattgaacgaaatcttcaagaagattgacttgcaatattacgaacatgttgatttgtacaccatttctgttcaatttcaagttttcagacatcatggttacaaattgtcctctgatgtttttaagaagttcaaggataacaatactggtactttcactgatgatgttactaaagatgttaagggcatgttgtctttgtatgaatctgctcatttgagattgcatggtgaagatttgttggatgaagctttggcttttactgaagctcaattgaagagaattgtttctactttggaaggtgatttggctagacaagttaatcaagtcttgaaaagaccatttcatactggtatgccaatggttgaagctagattgtatttctctacccatgaagaagatttttcttctcacgaatctgttgttaaattggctaaggttcattttaactacttgcaattgcaacaaaaagaagaattgagaatggtttctcaatggtggaaagatatggaatttcaaacttccgttccatatattagagatagagtcccagaaatttacttgtggattttgggtttgtattttgaaccatattactccagagctagaattattgctactaagatcactttgttcttggttgttttggatgatacttatgatgcttacgctaccattgatgaaattagatctattaccgatgctattaacagatgggaaatttctgctattgatcaattgccagaatacattaaaccattctacagaatcttgttgaatgaatacgatgacttggaaaaagaatactctaaagatggtagagctttttctgttcatgcttctaaacaagcttttcaagaaattgctagaggttatttggaagaagctgaatggttgcataatggttacgttgctacttttccagaatacatgaagaatggtttgattacttctgcttacaacgttatttctaagtctgctttggttggtatgggtgctattgctgatgaagaagctttagcttggtacgaaactcatccaaagattttgaaagcttctgaattgacttcaagattgcaagatgatgttatgactttccaattcgaaagaaaaagaggtcaatctgctactggtgttgatgcttacattaaagaatacaacgtttctgaagaagttgctatcaaagaattgatgaagatgattgaaaatgcttggaaggatattaatgaaggttgtttgaaaccaactgaagtttctgttgctttgttgactccaattttgaatttggccagaatgattgatgttgtttacaagtttgatgatggttttacttttccaggtaagactttgaaagattacattaccttgttgtttgtttctccaccaccatctttggagtaa

SEQ ID NO: 218 - DNA, 2080 bp, Artemisia annua
  amorpha-4,11-diene synthase
  CDS (13)...(1653): amorpha-4,11-diene synthase coding sequence
  ref <308>: DATABASE ACCESSION NUMBER: GenBank: AF138959.1
  ref <309>: DATABASE ENTRY DATE: 2000-09-25
gttttgaaaatcatgtcacttacagaagaaaaacctattcgccccattgccaactttcctccaagcatttggggagatcagtttctcatctatgaaaagcaagtagagcaaggggtggaacagatagtgaatgatttaaaaaaagaagtgcggcaactactaaaagaagctttggatattcctatgaaacatgccaatttattgaagctgattgatgaaatccaacgccttggaataccgtatcactttgaacgggagattgatcatgcattgcaatgtatttatgaaacatatggtgataactggaatggtgaccgctcttccttatggttccgtcttatgcgaaagcaaggatattatgttacatgtgatgttttcaataactataaagacaaaaatggagcgttcaagcaatcgttagctaatgatgttgaaggtttgcttgagttgtacgaagcaacttctatgagggtacctggggagattatattagaagatgctcttggttttacacgatctcgtcttagcattatgacaaaagatgctttttctacaaaccccgctctttttaccgaaatacaacgggcactaaagcaacccctttggaaaaggttgccaagaatagaggcggcgcagtacattcctttctatcaacaacaagattctcataacaagactttacttaaacttgctaagttagagttcaatttgcttcagtcattgcacaaggaagagctcagccatgtgtgcaaatggtggaaagctttcgatatcaagaagaacgcaccttgtttaagagatagaattgttgaatgctacttttggggactaggttcaggctatgagccacagtattcccgggctagagttttcttcacaaaagctgttgctgttataactcttatagatgacacttatgatgcgtatggtacttatgaagaacttaagatctttactgaagctgttgaaaggtggtcaattacatgcttagacacacttccagaatacatgaaaccgatatacaaattattcatggatacatacacagaaatggaagaatttcttgcaaaggagggaagaacagatctatttaactgcggcaaagaatttgtgaaagagtttgttagaaacctgatggttgaagcaaaatgggcaaatgagggacacataccaaccactgaagagcatgatccagttgtaatcattactggcggtgctaacctgcttacaacaacttgttatcttggcatgagtgatatattcacaaaagagtctgtcgaatgggctgtctctgcacctcctctttttagatactcaggtatacttggtcgacgcctaaatgatctcatgacccacaaggccgagcaagaaagaaaacatagttcatcgagccttgaaagttatatgaaggaatataatgtcaatgaggagtatgcccaaaccttgatttacaaggaagtagaagatgtgtggaaagatataaaccgagagtacctcacaactaaaaacattccaaggccgttattgatggctgtgatctatttgtgccagtttcttgaagttcaatatgcaggaaaggataacttcacacgtatgggagacgaatacaaacatctcataaagtctctactcgtttatcctatgagtatatgactaccaatccttcgtgcatagcctatcaattatattgaaagggttaactatgcacgtctctatggagagaatttctcaagctatttggtgtttggcaataataaatcagacgcataaaattgtattgaactatatgccgatagctatttaaagttattatacaactaaatattcaacaatggtattatacttttactttgtacaaaagcaaaagtacactactgttatgtaacattttagttctatgatactttagttacgaatcggcttatatacattgatacacttttatgcagaaaaccctagtaaataaaaagtcgatatcttgtactacacatatcgcacgaatttccgtttgccgtttgtatttttgatatgttatttaatgaatatgtttcatgggttgttgctaaaaaaaaaaaaaaaa

SEQ ID NO: 219 - DNA, 1659 bp, Artificial Sequence
  Santalene synthase SaSSy-87
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgacaacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 220 - DNA, 1659 bp, Artificial Sequence
  Santalene synthase SaSSy-88
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggccatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 221 - DNA, 1668 bp, Hyoscyamus muticus
  premnaspirodiene synthase
atggccccagctatagtgatgagtaactacgaagaggaggagattgttcgccctgttgcagatttttctccaagtctttggggtgatcatttccattcattctcagttgacaatcaggttgcggaaaagtatgctcaagagattgaaactttgaaggaacaaacaagtactatgttgtctgctgcttgtggaacaacattgactgagaaattgaatttgatagatattattgagcgccttggaatagcttatcatttcgagaaacaaatagaagatatgttggatcacatttacagagctgatccttattttgaggctcatgaatacaatgatttaaacacttcatccgttcaatttcgactactcagacaacatggttacaacgtctctccaaatatatttagcagattccaagatgcaaatggcaaattcaaggagtctcttagaagcgacatcaggggcctactgaacttatacgaagcttcacatgtaaggactcataaagaggatattttggaagaagcacttgttttttctgttggtcatcttgaatctgcagctccacatttgaagtcacctctgagtaagcaagtgacacatgccctcgaacaatctctccataagagcattccaagagtcgagatacggtacttcatctccatctacgaagaggaggaatttaagaatgatttgttgcttcgatttgctaaattggattacaacttacttcagatgttgcacaagcatgaactcagtgaagtatcaaggtggtggaaagatttggatttcgtgacaacacttccatatgctagggacagagcagttgagtgctacttttggacgatgggggtgtatgctgaacctcaatactcccaggctcgtgtcatgcttgctaagactatagcaatgatttccatagtagatgacacattcgatgcttatggcatcgtaaaagaacttgaagtctacacagatgccatacagaggtgggatattagtcaaattgatcgactcccggaatatatgaaaatcagttataaggctcttttggatctctatgacgattatgaaaaggagttgtcaaaggatggtagatccgatgttgtccactatgcaaaagaaagaatgaaggagattgtgggaaactattttattgaaggaaaatggtttattgagggatatatgccatctgtttccgagtaccttagcaatgcactagctactagcacatattacttgctaactacgacatcctacttgggaatgaaatcagcaaccaaggaacattttgaatggttggctacgaaccctaaaattctggaagctaatgctacattatgccgagttgttgatgacatagccacgtatgaggttgagaagggtaggggtcaaattgcaacaggaattgagtgttatatgagggattacggtgtatccacagaagtagcaatggagaaattccaagaaatggctgacatagcatggaaggatgtaaatgaagaaattcttcgaccaacacctgtctcttcagaaattcttactcgtattctcaacctggctcgaattatagatgtcacttacaagcataatcaagatggatacactcatcctgaaaaagtactaaaacctcacatcatcgccttggtggtggattctattgatatttga

SEQ ID NO: 222 - DNA, 1659 bp, Artificial Sequence
  Santalene synthase SaSSy-90
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaactcaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 223 - DNA, 1659 bp, Artificial Sequence
  Santalene synthase SaSSy-91
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggtagccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 224 - DNA, 1659 bp, Artificial Sequence
  Santalene synthase SaSSy-92
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggtacgcatttggctaagagagttaggcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 225 - DNA, 1659 bp, Artificial Sequence
  Santalene synthase SaSSy-119
atggctccagctatcgttatgtctaactacgaagaagaagaaatcgctagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaactggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggtacccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttgggccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 226 - DNA, 1659 bp, Artificial Sequence
  Santalene synthase SaSSy-94
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagttggtcgtgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 227 - DNA, 1659 bp, Artificial Sequence
  Santalene synthase SaSSy-95
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggttacaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 228 - DNA, 1659 bp, Artificial Sequence
  Santalene synthase SaSSy-96
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacccttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 229 - DNA, 1659 bp, Artificial Sequence
  Santalene synthase SaSSy-120
atggctccagctatcgttatgtctaactacgaagaagaagaaatcgttagaagaatgggtaactacaagccatccatttggaactatgatttcttgcaatctttggccacccatcacaatagggttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 230 - DNA, 1659 bp, Artificial Sequence
  Santalene synthase SaSSy-121
atggctccagctatcgttatgtctaactacgaagaagaagaaatcgttagaagaatgggtaactacaagccatccatttggaactatgatttcttgcaatctttggccacccatcacaataaagttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 231 - DNA, 1659 bp, Artificial Sequence
  Santalene synthase SaSSy-122
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccgattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttggcgttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 232 - DNA, 1659 bp, Artificial Sequence
  Santalene synthase SaSSy-123
atggctccagctatcgttatgtctaactacgaagaagaagaaatcgttagaagaatgggtaactacaagccatccatttggaactatgatttcttgcaatctttggccacccatcacaatatcgttgaagaaaggcatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttgcagattcttggacaaaagttgacatgaagtccgttttgattgacccaattccattaggtgaagaatga

SEQ ID NO: 233 - protein, 552 aa, Artificial Sequence
  Santalene synthase SaSSy-118
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGEWPRWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 234 - DNA, 1659 bp, Artificial Sequence
  Santalene synthase SaSSy-102
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttgggccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 235 - DNA, 1659 bp, Artificial Sequence
  Santalene synthase SaSSy-124
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttagtgattcttggacaaaagttgacatgaagtccgttttgattgacccaattccattaggtgaagaatga

SEQ ID NO: 236 - DNA, 1659 bp, Artificial Sequence
  Santalene synthase SaSSy-104
atggctccagctatcgttatgtctaactacgaagaaggagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatagtgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggtcgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 237 - DNA, 1659 bp, Artificial Sequence
  Santalene synthase SaSSy-125
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatgctccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaagcgattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 238 - DNA, 1659 bp, Artificial Sequence
  Santalene synthase SaSSy-126
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaagaacaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 239 - DNA, 1713 bp, Santalum album
  santalene synthase P143S
atggattcttccaccgccaccgccatgacagctccattcattgatcctactgatcatgtgaatctcaaaactgatacggatgcctcagagaatcgaaggatgggaaattataaacccagcatttggaattatgattttttacaatcacttgcaactcatcacaatattgtggaagagaggcatctaaagctagctgagaagctgaagggccaagtgaagtttatgtttggggcaccaatggagccgttagcaaagctggagcttgtggatgtggttcaaaggcttgggctaaaccacctatttgagacagagatcaaggaagcgctgtttagtatttacaaggatgggagcaatggatggtggtttggccaccttcatgcgacatctctccgatttaggctgctacgacagtgtgggctttttatttcccaagatgtgtttaaaacgttccaaaacaagactggggaatttgatatgaaactttgtgacaacgtaaaagggctgctgagcttatatgaagcttcatacttgggatggaagggtgaaaacatcctagatgaagccaaggccttcaccaccaagtgcttgaaaagtgcatgggaaaatatatccgaaaagtggttagccaaaagagtgaagcatgcattggctttgcctttgcattggagagtccctcgaatcgaagctagatggttcattgaggcatatgagcaagaagcgaatatgaacccaacactactcaaactcgcaaaattagactttaatatggtgcaatcaattcatcagaaagagattggggaattagcaaggtggtgggtgactactggcttggataagttagcctttgccaggaataatttactgcagagctatatgtggagctgcgcgattgcttccgacccgaagttcaaacttgctagagaaactattgtcgaaatcggaagtgtactcacagttgttgacgatggatatgacgtctatggttcaatcgacgaacttgatctctacacaagctccgttgaaaggtggagctgtgtggaaattgacaagttgccaaacacgttaaaattaatttttatgtctatgttcaacaagaccaatgaggttggccttcgagtccagcatgagcgaggctacaatagcatccctacttttatcaaagcgtgggttgaacagtgtaaatcataccagaaagaagcaagatggttccacgggggacacacgcctccattggaagaatatagcttgaatggacttgtttccataggattccctctcttgttaatcacgggctacgtggcaatcgctgagaacgaggctgcactggataaagtgcacccccttcctgatcttctgcactactcctccctccttagtcgcctcatcaatgatataggaacgtctccggatgagatggcaagaggcgataatctgaagtcaatccattgttacatgaacgaaactggggcttccgaggaagttgctcgtgagcacataaagggagtaatcgaggagaattggaaaatactgaatcagtgctgctttgatcaatctcagtttcaggagccttttataaccttcaatttgaactctgttcgagggtctcatttcttctatgaatttggggatggctttggggtgacggatagctggacaaaggttgatatgaagtccgttttgatcgaccctattcctctcggcgaggagtagtaa

SEQ ID NO: 240 - DNA, 1659 bp, Artificial Sequence
  Santalene synthase SaSSy-127
atggctccagctatcgttatgtctaactacgaagaagaagaaatcgttagaagaatgggtaactacaagccatccatttggaactatgatttcttgcaatctttggccacccatcacaatatcgttgaagaaagacatttgaagcaagccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgagcaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 241 - DNA, 1659 bp, Artificial Sequence
  Santalene synthase SaSSy-128
atggctccagctatcgttatgtctaactacgaagaagaagaaatcgttagaagaatgggtaactacaagccatccatttggaactatgatttcttgcaatctttggccacccatcacaatatcgttgaagaaagacatttgaaggaggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 242 - DNA, 1659 bp, Artificial Sequence
  Santalene synthase SaSSy-129
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgacgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttccgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgattcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 243 - protein, 552 aa, Artificial Sequence
  Santalene synthase SaSSy-113, SaSSy-131
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHEDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 244 - protein, 567 aa, Artificial Sequence
  Santalene synthase SaSSy-134
MDSSTATATTAPFIDPTNHVNLKIDNDSSENRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGGHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVEGWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 245 - protein, 552 aa, Artificial Sequence
  Santalene synthase SaSSy-90
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNSTGASEEVAREHIKGIIEENWKILNQCCFDQSQFQEPFITFNLNSVRGSHFFYEFGDGFGVTDSWTKVDMKSVLIDPIPLGEE

SEQ ID NO: 246 - protein, 552 aa, Artificial Sequence
  Santalene synthase SaSSy-92
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGTHLAKRVRHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 247 - protein, 552 aa, Artificial Sequence
  Santalene synthase SaSSy-119
MAPAIVMSNYEEEEIARRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGTHLAKRVKHALALPLHWRVPRIEARWFIEAYEQEENMNPTLLKLAKLDFNMVQSIHQKEIGELARWWVTTGLDKLAWARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 248 - protein, 552 aa, Artificial Sequence
  Santalene synthase SaSSy-94
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVESWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 249 - protein, 552 aa, Artificial Sequence
  Santalene synthase SaSSy-95
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGYKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 250 - protein, 552 aa, Artificial Sequence
  Santalene synthase SaSSy-96
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTLIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 251 - protein, 552 aa, Artificial Sequence
  Santalene synthase SaSSy-120
MAPAIVMSNYEEEEIVRRMGNYKPSIWNYDFLQSLATHHNRVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 252 - protein, 552 aa, Artificial Sequence
  Santalene synthase SaSSy-121
MAPAIVMSNYEEEEIVRRMGNYKPSIWNYDFLQSLATHHNKVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 253 - protein, 552 aa, Artificial Sequence
  Santalene synthase SaSSy-122
MAPAIVMSNYEEEEIVRRMGNYKPSIWNYDFLQSLATHHNIVEERHLKLAEKLKGQVRILLKEKMEPLARLELVDVVQRLGLNHLLETEIKEALFSIYKDHIDSDKADLHATSLRFRLLRQQGIKISCDVFEQFKDDEDRFKSSLINDIQGMLALYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 254 - protein, 552 aa, Artificial Sequence
  Santalene synthase SaSSy-123
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVADSWTKVDMKSVLIDPIPLGEE

SEQ ID NO: 255 - protein, 552 aa, Artificial Sequence
  Santalene synthase SaSSy-104
MAPAIVMSNYEEGEIVRRMGNYKPSIWNYDFLQSLATHHNIVEERHLKLAEKLKGQVRILLKEKMEPLAQLELVDVVQRLGLNHLLETEIKEALFSIYKDHSDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 256 - protein, 552 aa, Artificial Sequence
  Santalene synthase SaSSy-124
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVSDSWTKVDMKSVLIDPIPLGEE

SEQ ID NO: 257 - protein, 552 aa, Artificial Sequence
  Santalene synthase SaSSy-125
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHAPPLEEYSLNGLVSIGFPLLLITGYIAIAENEAALDKVRPLPDLLHYSSLLSRLINDMGTSPDEMARGDNLKAIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 258 - protein, 569 aa, Santalum album
  santalene synthase P143S
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDGSNGWWFGHLHATSLRFRLLRQCGLFISQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 259 - protein, 552 aa, Artificial Sequence
  Santalene synthase SaSSy-126
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQEQFQEPFITFNLNSVRGSHFFYEFGDGFGVTDSWTKVDMKSVLIDPIPLGEE

SEQ ID NO: 260 - protein, 552 aa, Artificial Sequence
  Santalene synthase SaSSy-127
MAPAIVMSNYEEEEIVRRMGNYKPSIWNYDFLQSLATHHNIVEERHLKQAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 261 - protein, 552 aa, Artificial Sequence
  Santalene synthase SaSSy-128
MAPAIVMSNYEEEEIVRRMGNYKPSIWNYDFLQSLATHHNIVEERHLKEAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 262 - DNA, 1659 bp, Artificial Sequence
  Santalene synthase SaSSy-111
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctcccaatacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 263 - DNA, 1605 bp, Artificial Sequence
  Santalene synthase SaSSy-112
atgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 264 - DNA, 1659 bp, Artificial Sequence
  Santalene synthase SaSSy-113
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatgaggattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 265 - DNA, 1659 bp, Artificial Sequence
  Santalene synthase SaSSy-114
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagtcagaatcttgttgaaagaaaagatggaaccattggcccaattggaattggttgatgttgttcaaagattgggtttgaaccacttgttggaaaccgaaatcaaagaagccttgttctccatctacaaggatcatatagattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 266 - protein, 552 aa, Artificial Sequence
  Santalene synthase SaSSy-111
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSQYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 267 - protein, 534 aa, Artificial Sequence
  Santalene synthase SaSSy-112
MGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 268 - protein, 598 aa, Salvia officinalis
  bornyl diphosphate synthase
  ref <308>: DATABASE ACCESSION NUMBER: GenBank: AAC26017.1
  ref <309>: DATABASE ENTRY DATE: 1998-07-11
MSIISMNVSILSKPLNCLHNLERRPSKALLVPCTAPTARLRASCSSKLQEAHQIRRSGNYQPALWDSNYIQSLNTPYTEERHLDRKAELIVQVRILLKEKMEPVQQLELIHDLKYLGLSDFFQDEIKEILGVIYNEHKCFHNNEVEKMDLYFTALGFRLLRQHGFNISQDVFNCFKNEKGIDFKASLAQDTKGMLQLYEASFLLRKGEDTLELAREFATKCLQKKLDEGGNEIDENLLLWIRHSLDLPLHWRIQSVEARWFIDAYARRPDMNPLIFELAKLNFNIIQATHQQELKDLSRWWSRLCFPEKLPFVRDRLVESFFWAVGMFEPHQHGYQRKMAATIIVLATVIDDIYDVYGTLDELELFTDTFKRWDTESITRLPYYMQLCYWGVHNYISDAAYDILKEHGFFCLQYLRKSVVDLVEAYFHEAKWYHSGYTPSLDEYLNIAKISVASPAIISPTYFTFANASHDTAVIDSLYQYHDILCLAGIILRLPDDLGTSYFELARGDVPKTIQCYMKETNASEEEAVEHVKFLIREAWKDMNTAIAAGYPFPDGMVAGAANIGRVAQFIYLHGDGFGVQHSKTYEHIAGLLFEPYA

SEQ ID NO: 269 - protein, 548 aa, Artificial Sequence
  Citrus valencene synthase V19
MSSGETFRPTADFHPSLWRNHFLQGASDFKTVDHTATNERHEALKEEVRRMITDAEDQPIQKLRLIDEVQRLGVAYHFEKEIEDAIQQLCPIHIDSDKADLHTVSLHFRLLRQQGIKISCDVFEQFKDDEGRFKSSLINDVQGMLSLYEAAYMAVRGEHILDEAIAFTTTHLQSLVAQDHVTPRLAEQINHALYRPLRKTLPRLEARYIMSRIDSTSDDLVNKTLLNFAKLDFNILLDLHKEELNELTKWWQDLDFTTKLPYARDRLVELYFWDLGTYFEPQYAFGRKIMTKLNYILSIIDDTYDAYGTLEELSLFTEAVARWNIEAVDMLPDYMKLIYRTLLDTFNEIEEDMAKQGRSHCVRYAKEEIQKVIGAYYVQAKWFSEGYVPTIEEYMPIALTSCAYRFVITNSFLGMGDFATKEVFEWISGNPKVVKSASVICRLMDDMQGHEFEQKRGHVASAIECYTKQHGVSKEEAIKMFEEEVANAWKDINEELMMKPPVVARPLLGTILNLARAIDFIYKEDDGYTHSYLIKEQIASVLGDHVPF

SEQ ID NO: 270 - protein, 556 aa, Vitis vinifera
  valencene synthase
MSTQVSASSLAQIPQPKNRPVANFHPNIWGDQFITYTPEDKVTRACKEEQIEDLKKEVKRKLTAAAVANPSQLLNFIDAVQRLGVAYHFEQEIEEALQHICNSFHDCNDMDGDLYNIALGFRLLRQQGYTISCDIFNKFTDERGRFKEALISDVRGMLGLYEAAHLRVHGEDILAKALAFTTTHLKAMVESLGYHLAEQVAHALNRPIRKGLERLEARWYISVYQDEAFHDKTLLELAKLDFNLVQSLHKEELSNLARWWKELDFATKLPFARDRLVEGYFWMHGVYFEPQYLRGRRILTKVIAMTSILDDIHDAYGTPEELKLFIEAIERWDINSINQLPEYMKLCYVALLDVYKEIEEEMEKEGNQYRVHYAKEVMKNQVRAYFAEAKWLHEEHVPAFEEYMRVALASSGYCLLATTSFVGMGEIATKEAFDWVTSDPKIMSSSNFITRLMDDIKSHKFEQKRGHVASAVECYMKQYGVSEEQVYSEFQKQIENAWLDINQECLKPTAVSMPLLARLLNLTRTMDVIYKEQDSYTHVGKVMRDNIASVFINAVI

SEQ ID NO: 271 - protein, 541 aa, Salvia sclarea
  Bergamotene synthase
MEELRRSANFEASIWDDDYIQSLTSSYAGGNYVGEAEKLKDLVKIMIDETEDVVNQLELIDNLQRLGLSHHLELEDRIAKMLHNIYENFQHMEKDLYVTALGFRLLRQHGHHVPQEAFCSFMDDVRNFRAWLCEDVRGLLSLYEASYLSAEGESILDLAKDFSRDHLGRGLDHITEVHVAERVRHALELPLHWRMGRLEARWFIQAYENTSEANLILVELSKLDFNMVQATYQEELKRMSRWYKESGLPEKLGFARHRLAECFLWAMGFVPERQHGYSREVLVKIAVLITIMDDIYDVYGSLEELQLFTQTIERWDINSLDSLPEYMRIFFLALFNSANELAYDILRDQGFNVISNLRKLWTQLSRAYYLEAKWFHSGYVPTTDEYLKQAWISISGPLLLFYAYFTTNPICNKELHMLEQYPGIIRWPSTVLRLADDLGTSSDEMKRGDVPKSVQCYMKETGCSEEDARKHVKQLMEAALKRMNKEIVMEKPLKNFGDTAMNLGRISLCFYQHGDGFGLPHSQTKQNMVSLLVQPFPMHLN

SEQ ID NO: 272 - protein, 555 aa, Hyoscyamus muticus
  premnaspirodiene synthase
MAPAIVMSNYEEEEIVRPVADFSPSLWGDHFHSFSVDNQVAEKYAQEIETLKEQTSTMLSAACGTTLTEKLNLIDIIERLGIAYHFEKQIEDMLDHIYRADPYFEAHEYNDLNTSSVQFRLLRQHGYNVSPNIFSRFQDANGKFKESLRSDIRGLLNLYEASHVRTHKEDILEEALVFSVGHLESAAPHLKSPLSKQVTHALEQSLHKSIPRVEIRYFISIYEEEEFKNDLLLRFAKLDYNLLQMLHKHELSEVSRWWKDLDFVTTLPYARDRAVECYFWTMGVYAEPQYSQARVMLAKTIAMISIVDDTFDAYGIVKELEVYTDAIQRWDISQIDRLPEYMKISYKALLDLYDDYEKELSKDGRSDVVHYAKERMKEIVGNYFIEGKWFIEGYMPSVSEYLSNALATSTYYLLTTTSYLGMKSATKEHFEWLATNPKILEANATLCRVVDDIATYEVEKGRGQIATGIECYMRDYGVSTEVAMEKFQEMADIAWKDVNEEILRPTPVSSEILTRILNLARIIDVTYKHNQDGYTHPEKVLKPHIIALVVDSIDI

SEQ ID NO: 273 - protein, 466 aa, Nicotiana tabacum
  5-epi-aristolochene synthase
MASAAVGNYEEEIVRPVADFSPSLWGDQFLSFSIKNQVAEKYAKEIEALKEQTRNMLLATGMKLADTLNLIDIIERLGISYHFEKEIDEILDQIYNQNSNCDDLCISALQFRLLRQHGFNISPEIFSKFQDENGKFKESLASDVLGLLNLYEASHVRTHADDILEDALAFSTIHLESAAPHLKSPLKEQVTHALEQCLHKGVPRVETRFFISSIYDKEQSKNNVLLRFAKLDFNLLQMLHKQELAQVSRWWKDLDFVTTLPYARDRVVECYFWALGVYFEPQYSQARVMLVKTISMISIVDDTFDAYGTVKELEAFTDPIQRWDINEIDRLPDYMKISYKAILDLFKDYEKELSSAGRSHIVFHAIERVEKSRGQIATGIECCMRDYGITTKEAMTKFQEMAEAAWKDLNEGLLRPTPVATEFLSRILNLARIVEVTYIHNLDGYTHPEKVLKPHINALLVDSIDI

SEQ ID NO: 274 - protein, 582 aa, Artificial Sequence
  germacrene A synthase
MALVRNNSSNGREPILSPRSLTSPRGLTSPRPLTVQPTQEPVRPLANFPPSIWADRFISFSLDNNELEAYANALEGPKEAVRNLITDTTFDATAKLKLIYSVHRLGLSYLYPEEIDTELNEIFKKIDLQYYEHVDLYTISVQFQVFRHHGYKLSSDVFKKFKDNNTGTFTDDVTKDVKGMLSLYESAHLRLHGEDLLDEALAFTEAQLKRIVSTLEGDLARQVNQVLKRPFHTGMPMVEARLYFSTHEEDFSSHESVVKLAKVHFNYLQLQQKEELRMVSQWWKDMEFQTSVPYIRDRVPEIYLWILGLYFEPYYSRARIIATKITLFLVVLDDTYDAYATIDEIRSITDAINRWEISAIDQLPEYIKPFYRILLNEYDDLEKEYSKDGRAFSVHASKQAFQEIARGYLEEAEWLHNGYVATFPEYMKNGLITSAYNVISKSALVGMGAIADEEALAWYETHPKILKASELTSRLQDDVMTFQFERKRGQSATGVDAYIKEYNVSEEVAIKELMKMIENAWKDINEGCLKPTEVSVALLTPILNLARMIDVVYKFDDGFTFPGKTLKDYITLLFVSPPPSLE

SEQ ID NO: 275 - protein, 546 aa, Artemisia annua
  amorpha-4,11-diene synthase
  ref <308>: DATABASE ACCESSION NUMBER: GenBank: AAF61439.1
  ref <309>: DATABASE ENTRY DATE: 2000-09-25
MSLTEEKPIRPIANFPPSIWGDQFLIYEKQVEQGVEQIVNDLKKEVRQLLKEALDIPMKHANLLKLIDEIQRLGIPYHFEREIDHALQCIYETYGDNWNGDRSSLWFRLMRKQGYYVTCDVFNNYKDKNGAFKQSLANDVEGLLELYEATSMRVPGEIILEDALGFTRSRLSIMTKDAFSTNPALFTEIQRALKQPLWKRLPRIEAAQYIPFYQQQDSHNKTLLKLAKLEFNLLQSLHKEELSHVCKWWKAFDIKKNAPCLRDRIVECYFWGLGSGYEPQYSRARVFFTKAVAVITLIDDTYDAYGTYEELKIFTEAVERWSITCLDTLPEYMKPIYKLFMDTYTEMEEFLAKEGRTDLFNCGKEFVKEFVRNLMVEAKWANEGHIPTTEEHDPVVIITGGANLLTTTCYLGMSDIFTKESVEWAVSAPPLFRYSGILGRRLNDLMTHKAEQERKHSSSSLESYMKEYNVNEEYAQTLIYKEVEDVWKDINREYLTTKNIPRPLLMAVIYLCQFLEVQYAGKDNFTRMGDEYKHLIKSLLVYPMSI

SEQ ID NO: 276 - protein, 555 aa, Hyoscyamus muticus; identical to SEQ ID NO: 272
  Vetispiradiene synthase

SEQ ID NO: 277 - protein, 552 aa, Artificial Sequence
  Santalene synthase SaSSy-129
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLIHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 278 - DNA, 1659 bp, Artificial Sequence
  Santalene synthase SaSSy-130
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatgatgattctgataaggctgacttgcatgctacatctttgagattcagattattgagacaacagggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 279 - DNA, 1659 bp, Artificial Sequence
  Santalene synthase SaSSy-131
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatgaagattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaagtctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 280 - DNA, 1659 bp, Artificial Sequence
  Santalene synthase SaSSy-132
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcataatgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggttaccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 281 - DNA, 1659 bp, Artificial Sequence
  Santalene synthase SaSSy-133
atggctccagctatcgttatgtctaactacgaagaagaagaaatcgctagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggtacgcatttggctaagagagttaggcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggtatcaactctatcccaaccttgattaaggcctgggttgaacaatgtaaggcctatcaaaaagaagccagatggtatcacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgctaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 282 - DNA, 1704 bp, Artificial Sequence
  Santalene synthase SaSSy-134
atggactcttctactgctaccgctactactgctccttttattgatccaaccaatcacgtcaacttgaagatcgataacgattcctctgaaaacagaagaatgggtaactacaagccatccatttggaactatgatttcttgcaatctttggccacccatcacaatatcgttgaagaaagacatttgaagttggccgaaaagttgaagggccaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggtggtcatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaggatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 283 - protein, 552 aa, Artificial Sequence
  Santalene synthase SaSSy-130
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHDDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 284 - DNA, 7139 bp, Artificial Sequence
  pAlx48-16.2 expression vector
cgcggccgcgtggaatatttcggatatccttttgttgtttccgggtgtacaatatggacttcctcttttctggcaaccaaacccatacatcgggattcctataataccttcgttggtctccctaacatgtaggtggcggaggggagatatacaatagaacagataccagacaagacataatgggctaaacaagactacaccaattacactgcctcattgatggtggtacataacgaactaatactgtagccctagacttgatagccatcatcatatcgaagtttcactaccctttttccatttgccatctattgaagtaataataggcgcatgcaacttcttttctttttttttcttttctctctcccccgttgttgtctcaccatatccgcaatgacaaaaaaatgatggaagacactaaaggaaaaaattaacgacaaagacagcaccaacagatgtcgttgttccagagctgatgaggggtatctcgaagcacacgaaactttttccttccttcattcacgcacactactctctaatgagcaacggtatacggccttccttccagttacttgaatttgaaataaaaaaaagtttgctgtcttgctatcaagtataaatagacctgcaattattaatcttttgtttcctcgtcattgttctcgttccctttcttccttgtttctttttctgcacaatatttcaagctataccaagcatacaatcaactccaagctgaattcgagctcggtacctttaaaaaaaagatggtgggttactactggtttggataagttggctttcgctagaaacaacttgttgcaatcctacatgtggtcttgtgctattgcttctgacccaaagtttaagttggccagagaaaccatagttgaaatcggttccgttttgaccgttgttgatgatggttacgatgtttacggttccatcgatgaattggacttgtacacctcttctgttgaaagatggtcctgcgttgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattccttgaacggtttggtttctattggtttccctttgttgttgattacaggttacgttgctattgctgaaaatgaagccgctttggataaggttcatccattgccagatttgttgcactactcatccttgttgtccagattgatcaacgatattggtacttctccagacgaaatggctagaggtgataacttgaagtccatccactgttacatgaacgaaactggtgcttctgaagaagttgctagagaacacatcaagggtgtcattgaagaaaactggaagatcttgaatcaatgctgcttcgatcaatcccaattccaagaaccattcatcaccttcaacttgaactctgttagaggttcccatttcttctacgaattcggtgatggttttggtgttactgattcctggaccaaggttgatatgaagtccgttttgatcgatccaattccattgggtgaagaatgaacccagctttcttgtacaaagtggttgatggctctagaatctctgcttttgtgcgcgtatgtttatgtatgtacctctctctctatttctatttttaaaccaccctctcaataaaataaaaataataaagtatttttaaggaaaagacgtgtttaagcactgactttatctactttttgtacgttttcattgatataatgtgttttgtctctcccttttctacgaaaatttcaaaaattgaccaaaaaaaggaatatatatacgaaaaactattatatttatatatcatagtgttgataaaaaatgtttatccattggaccgtgtatcagggcccggatcctctaggcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtaaaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacataccacgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgacgcaacgcaattaatgtgagttagctcactcattaggcaccccaggctttacactttatgcttccggctcgtatgttgtgtggaattgtgagcggataacaatttcacacaggaaacagctatgacatgatta

SEQ ID NO: 285 - protein, 552 aa, Artificial Sequence
  Santalene synthase SaSSy-132
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHNDSDKADLHATSLRFRLLRQQGIKISCDVFEQFKDDEDRFKSSLINDIQGMLSLYEASFLGWKGENILDEAKAFATKYLKAMVESLGYHLAKRVKHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 286 - protein, 552 aa, Artificial Sequence
  Santalene synthase SaSSy-133
MAPAIVMSNYEEEEIARRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGENILDEAKAFATKYLKAMVESLGTHLAKRVRHALALPLHWRVPRIEARWFIEAYEQEENMNPTLLKLAKLDFNMVQSIHQKEIGELARWWVTTGLDKLAFARNNLLQSYMWSCAIASDPKFKLARETIVEIGSVLTVVDDAYDVYGHMDELDLYTSSVERWSCAEIDRLPDTLKLIFMSMFNKTNEVGLRVQHERGINSIPTLIKAWVEQCKAYQKEARWYHGGHTPPLEEYSLNGLVSIGFPLLLITGYIAIAENEAALDKVRPLPDLLHYSSLLSRLINDMGTSPDEMARGDNLKSIHCYMNATGASEEVAREHIKGIIEENWKILNQCCFDQSQFQEPFITFNLNSVRGSHFFYEFGDGFGVTDSWTKVDMKSVLIDPIPLGEE

SEQ ID NO: 287 - DNA, 1707 bp, Artificial Sequence
  Santalene synthase SaSSy-37
atggattcttccactgctactgctatgactgctccattcattgatccaaccgatcacgttaacttgaaaaccgataccgatgcttctgaaaacagaagaatgggtaactacaagccatctatctggaactacgacttcttgcaatctttggctacccatcacaacatagtcgaagaaagacatttgaagttggccgaaaagttgaaaggtcaagtcaagtttatgttcggtgctccaatggaaccattggctaagttggaattggttgacgttgttcaaagattgggtttgaaccacttgttcgaaaccgaaatcaaagaagccttgttctccatctacaaggatcatattgattctgataaagctgatttgcacgctacatccttgagattcagattattgagacaatgcggtttgttcatcccacaagacgttttcaagaccttccaaaacaagactggtgaattcgatatgaagttgtgcgataacgttaagggtttgttgtccttgtatgaagcttcttacttgggttggaagggtgaaaacattttggatgaagctaaggctttcactaccaagtgtttgaaatccgcttgggaaaacatttctgaaaagtggttggccaaaagagttaagcacgctttggctttgccattgcattggagagttccaagaattgaagccagatggttcattgaagcctacgaacaagaggctaacatgaacccaaccttgttgaagttggcaaagttggatttcaacatggttcaatccatccaccaaaaagaaattggtgaattggctagatggtgggttactactggtttggataagttggctttcgctagaaacaacttgttgcaatcctacatgtggtcttgtgctattgcttctgacccaaagtttaagttggccagagaaaccatagttgaaatcggttccgttttgaccgttgttgatgatggttacgatgtttacggttccatcgatgaattggacttgtacacctcttctgttgaaagatggtcctgcgtggaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattccttgaacggtttggtttctattggtttccctttgttgttgattacaggttacgttgctattgctgaaaatgaagccgctttggataaggttcatccattgccagatttgttgcactactcatccttgttgtccagattgatcaacgatattggtacttctccagacgaaatggctagaggtgataacttgaagtccatccactgttacatgaacgaaactggtgcttctgaagaagttgctagagaacacatcaagggtgtcattgaagaaaactggaagatcttgaatcaatgctgcttcgatcaatcccaattccaagaaccattcatcaccttcaacttgaactctgttagaggttcccatttcttctacgaattcggtgatggttttggtgttactgattcctggaccaaggttgatatgaagtccgttttgatcgatccaattccattgggtgaagaatga

SEQ ID NO: 288 - protein, 568 aa, Artificial Sequence
  Santalene synthase SaSSy-37
MDSSTATAMTAPFIDPTDHVNLKTDTDASENRRMGNYKPSIWNYDFLQSLATHHNIVEERHLKLAEKLKGQVKFMFGAPMEPLAKLELVDVVQRLGLNHLFETEIKEALFSIYKDHIDSDKADLHATSLRFRLLRQCGLFIPQDVFKTFQNKTGEFDMKLCDNVKGLLSLYEASYLGWKGENILDEAKAFTTKCLKSAWENISEKWLAKRVKHALALPLHWRVPRIEARWFIEAYEQEANMNPTLLKLAKLDFNMVQSIHQKEIGELARWWVTTGLDKLAFARNNLLQSYMWSCAIASDPKFKLARETIVEIGSVLTVVDDGYDVYGSIDELDLYTSSVERWSCVEIDKLPNTLKLIFMSMFNKTNEVGLRVQHERGYNSIPTFIKAWVEQCKSYQKEARWFHGGHTPPLEEYSLNGLVSIGFPLLLITGYVAIAENEAALDKVHPLPDLLHYSSLLSRLINDIGTSPDEMARGDNLKSIHCYMNETGASEEVAREHIKGVIEENWKILNQCCFDQSQFQEPFITFNLNSVRGSHFFYEFGDGFGVTDSWTKVDMKSVLIDPIPLGEE

SEQ ID NO: 289 - DNA, 901 bp, Artificial Sequence
  inactive version of codon-optimized SaSSy
atggtgggttactactggtttggataagttggctttcgctagaaacaacttgttgcaatcctacatgtggtcttgtgctattgcttctgacccaaagtttaagttggccagagaaaccatagttgaaatcggttccgttttgaccgttgttgatgatggttacgatgtttacggttccatcgatgaattggacttgtacacctcttctgttgaaagatggtcctgcgttgaaattgataagttgccaaacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattccttgaacggtttggtttctattggtttccctttgttgttgattacaggttacgttgctattgctgaaaatgaagccgctttggataaggttcatccattgccagatttgttgcactactcatccttgttgtccagattgatcaacgatattggtacttctccagacgaaatggctagaggtgataacttgaagtccatccactgttacatgaacgaaactggtgcttctgaagaagttgctagagaacacatcaagggtgtcattgaagaaaactggaagatcttgaatcaatgctgcttcgatcaatcccaattccaagaaccattcatcaccttcaacttgaactctgttagaggttcccatttcttctacgaattcggtgatggttttggtgttactgattcctggaccaaggttgatatgaagtccgttttgatcgatccaattccattgggtgaagaatga

SEQ ID NO: 290 - DNA, 7138 bp, Artificial Sequence
  pAlx72-5.4  expression vector
cgcggccgcgtggaatatttcggatatccttttgttgtttccgggtgtacaatatggacttcctcttttctggcaaccaaacccatacatcgggattcctataataccttcgttggtctccctaacatgtaggtggcggaggggagatatacaatagaacagataccagacaagacataatgggctaaacaagactacaccaattacactgcctcattgatggtggtacataacgaactaatactgtagccctagacttgatagccatcatcatatcgaagtttcactaccctttttccatttgccatctattgaagtaataataggcgcatgcaacttcttttctttttttttcttttctctctcccccgttgttgtctcaccatatccgcaatgacaaaaaaatgatggaagacactaaaggaaaaaattaacgacaaagacagcaccaacagatgtcgttgttccagagctgatgaggggtatctcgaagcacacgaaactttttccttccttcattcacgcacactactctctaatgagcaacggtatacggccttccttccagttacttgaatttgaaataaaaaaaagtttgctgtcttgctatcaagtataaatagacctgcaattattaatcttttgtttcctcgtcattgttctcgttccctttcttccttgtttctttttctgcacaatatttcaagctataccaagcatacaatcaactccaagctgaattcgagctcggtacctttaaaaaaagatggtgggttactactggtttggataagttggcttttgccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatgaacccagctttcttgtacaaagtggttgatggctctagaatctctgcttttgtgcgcgtatgtttatgtatgtacctctctctctatttctatttttaaaccaccctctcaataaaataaaaataataaagtatttttaaggaaaagacgtgtttaagcactgactttatctactttttgtacgttttcattgatataatgtgttttgtctctcccttttctacgaaaatttcaaaaattgaccaaaaaaaggaatatatatacgaaaaactattatatttatatatcatagtgttgataaaaaatgtttatccattggaccgtgtatcagggcccggatcctctaggcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaggaaaccgaaatcaaaaaaaagaataaaaaaaaaatgatgaattgaaaagcacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtaaaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacataccacgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgacgcaacgcaattaatgtgagttagctcactcattaggcaccccaggctttacactttatgcttccggctcgtatgttgtgtggaattgtgagcggataacaatttcacacaggaaacagctatgacatgatta

SEQ ID NO: 291 - protein, 11 aa, Artificial Sequence
  arginine rich motif
  VARIANT 2: Xaa = Arg or Pro
  VARIANT 3, 4, 5, 6, 7, 8, 9, 10: Xaa = any amino acid
RXXXXXXXXXW

SEQ ID NO: 292 - DNA, 1647 bp, Citrus sinensis
  Citrus valencene synthase
atgtcgtctggagaaacatttcgtcctactgcagatttccatcctagtttatggagaaaccatttcctcaaaggtgcttctgatttcaagacagttgatcatactgcaactcaagaacgacacgaggcactgaaagaagaggtaaggagaatgataacagatgctgaagataagcctgttcagaagttacgcttgattgatgaagtacaacgcctgggggtggcttatcactttgagaaagaaatagaagatgcaatacaaaaattatgtccaatctatattgacagtaatagagctgatctccacaccgtttcccttcattttcgattgcttaggcagcaaggaatcaagatttcatgtgatgtgtttgagaagttcaaagatgatgagggtagattcaagtcatcgttgataaacgatgttcaagggatgttaagtttgtacgaggcagcatacatggcagttcgcggagaacatatattagatgaagccattgctttcactaccactcacctgaagtcattggtagctcaggatcatgtaacccctaagcttgcggaacagataaatcatgctttataccgtcctcttcgtaaaaccctaccaagattagaggcgaggtattttatgtccatgatcaattcaacaagtgatcatttatacaataaaactctgctgaattttgcaaagttagattttaacatattgctagagctgcacaaggaggaactcaatgaattaacaaagtggtggaaagatttagacttcactacaaaactaccttatgcaagagacagattagtggagttatatttttgggatttagggacatacttcgagcctcaatatgcatttgggagaaagataatgacccaattaaattacatattatccatcatagatgatacttatgatgcgtatggtacacttgaagaactcagcctctttactgaagcagttcaaagatggaatattgaggccgtagatatgcttccagaatacatgaaattgatttacaggacactcttagatgcttttaatgaaattgaggaagatatggccaagcaaggaagatcacactgcgtacgttatgcaaaagaggagaatcaaaaagtaattggagcatactctgttcaagccaaatggttcagtgaaggttacgttccaacaattgaggagtatatgcctattgcactaacaagttgtgcttacacattcgtcataacaaattccttccttggcatgggtgattttgcaactaaagaggtttttgaatggatctccaataaccctaaggttgtaaaagcagcatcagttatctgcagactcatggatgacatgcaaggtcatgagtttgagcagaagagaggacatgttgcgtcagctattgaatgttacacgaagcagcatggtgtctctaaggaagaggcaattaaaatgtttgaagaagaagttgcaaatgcatggaaagatattaacgaggagttgatgatgaagccaaccgtcgttgcccgaccactgctcgggacgattcttaatcttgctcgtgcaattgattttatttacaaagaggacgacggctatacgcattcttacctaattaaagatcaaattgcttctgtgctaggagaccacgttccattttga

SEQ ID NO: 293 - protein, 548 aa, Citrus sinensis
  Citrus Valencene Synthase
MSSGETFRPTADFHPSLWRNHFLKGASDFKTVDHTATQERHEALKEEVRRMITDAEDKPVQKLRLIDEVQRLGVAYHFEKEIEDAIQKLCPIYIDSNRADLHTVSLHFRLLRQQGIKISCDVFEKFKDDEGRFKSSLINDVQGMLSLYEAAYMAVRGEHILDEAIAFTTTHLKSLVAQDHVTPKLAEQINHALYRPLRKTLPRLEARYFMSMINSTSDHLYNKTLLNFAKLDFNILLELHKEELNELTKWWKDLDFTTKLPYARDRLVELYFWDLGTYFEPQYAFGRKIMTQLNYILSIIDDTYDAYGTLEELSLFTEAVQRWNIEAVDMLPEYMKLIYRTLLDAFNEIEEDMAKQGRSHCVRYAKEENQKVIGAYSVQAKWFSEGYVPTIEEYMPIALTSCAYTFVITNSFLGMGDFATKEVFEWISNNPKVVKAASVICRLMDDMQGHEFEQKRGHVASAIECYTKQHGVSKEEAIKMFEEEVANAWKDINEELMMKPTVVARPLLGTILNLARAIDFIYKEDDGYTHSYLIKDQIASVLGDHVPF

SEQ ID NO: 294 - protein, 31 aa, Artificial Sequence
  SaSSy amino acid  1-31
MDSSTATAMTAPFIDPTDHVNLKTDTDASEN

SEQ ID NO: 295 - protein, 7 aa, Artificial Sequence
  SaSSy amino acid 73-79
KFMFGAP

SEQ ID NO: 296 - protein, 4 aa, Artificial Sequence
  SaSSy amino acid 78-81
APME

SEQ ID NO: 297 - protein, 4 aa, Artificial Sequence
  SaSSy amino acid 97-100
LNHL

SEQ ID NO: 298 - protein, 13 aa, Artificial Sequence
  SaSSy amino acid 103-115
TEIKEALFSIYKD

SEQ ID NO: 299 - protein, 9 aa, Artificial Sequence
  SaSSy amino acid 116-124
GSNGWWFGH

SEQ ID NO: 300 - protein, 29 aa, Artificial Sequence
  SaSSy amino acid 138-166
CGLFIPQDVFKTFQNKTGEFDMKLCDNVK

SEQ ID NO: 301 - protein, 31 aa, Artificial Sequence
  SaSSy amino acid 138-168
CGLFIPQDVFKTFQNKTGEFDMKLCDNVKGL

SEQ ID NO: 302 - protein, 10 aa, Artificial Sequence
  SaSSy amino acid 198-207
SAWENISEKW

SEQ ID NO: 303 - protein, 19 aa, Artificial Sequence
  SaSSy amino acid 330-348
IDELDLYTSSVERWSCVEI

SEQ ID NO: 304 - DNA, 1659 bp, Artificial Sequence
  Santalene synthase SaSSy-55, SaSSy-101
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaacattttggatgaagctaaagctttcgccactaagtacttgaaagctatggttgaatctttgggtacccatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttgggccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 305 - protein, 574 aa, Artemisia annua
  (E)-beta-farnesene synthase
  ref <310>: PATENT DOCUMENT NUMBER: US8236512
  ref <311>: PATENT FILING DATE: 2012-02-01
  ref <312>: PUBLICATION DATE: 2012-08-07
MSTLPISSVSFSSSTSPLVVDDKVSTKPDVIRHTMNFNASIWGDQFLTYDEPEDLVMKKQLVEELKEEVKKELITIKGSNEPMQHVKLIELIDAVQRLGIAYHFEEEIEEALQHIHVTYGEQWVDKENLQSISLWFRLLRQQGFNVSSGVFKDFMDEKGKFKESLCNDAQGILALYEAAFMRVEDETILDNALEFTKVHLDIIAKDPSCDSSLRTQIHQALKQPLRRRLARIEALHYMPIYQQETSHDEVLLKLAKLDFSVLQSMHKKELSHICKWWKDLDLQNKLPYVRDRVVEGYFWILSIYYEPQHARTRMFLMKTCMWLVVLDDTFDNYGTYEELEIFTQAVERWSISCLDMLPEYMKLIYQELVNLHVEMEESLEKEGKTYQIHYVKEMAKELVRNYLVEARWLKEGYMPTLEEYMSVSMVTGTYGLMIARSYVGRGDIVTEDTFKWVSSYPPIIKASCVIVRLMDDIVSHKEEQERGHVASSIECYSKESGASEEEACEYISRKVEDAWKVINRESLRPTAVPFPLLMPAINLARMCEVLYSVNDGFTHAEGDMKSYMKSFFVHPMVV

SEQ ID NO: 306 - DNA, 1659 bp, Artificial Sequence
  Santalene synthase SaSSy-135
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaaaattttggatgaagctaaagctttcgccactaagtacttgaaagctatggttgaatctttgggtggtcatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttgggccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 307 - DNA, 1659 bp, Artificial Sequence
  Santalene synthase SaSSy-136
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaaaaaattttggatgaagctaaagctttcgccactaagtacttgaaagctatggttgaatctttgggttctcatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttgggccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 308 - DNA, 1659 bp, Artificial Sequence
  Santalene synthase SaSSy-137
atggctccagctatcgttatgtctaactacgaagaagaagaaatcgttagaagaatgggtaactacaagccatccatttggaactatgatttcttgcaatctttggccacccatcacaatatcgttgaagaaagacatttgaagttggccgaaaagttgaagggtcaagttagaatcttgttgaaagaaaagatggaaccattggcccaattggaattggttgatgttgttcaaagattgggtttgaaccacttgttggaaaccgaaatcaaagaagccttgttctccatctacaaggatcatatcgattctgataaggctgacttgcatgctacatctttgagattcagattattgagacaacaaggtatcaagatctcctgcgacgtttttgaacaattcaaggatgacgaagatagattcaagtcctccttgattaacgacatccaaggtatgttgtccttgtacgaagcttcatttttgggttggaagggtgaagacattttggatgaagctaaagctttcgccactaagtacttgaaagctatggttgaatctttgggtgctcatttggctaagagagttaagcacgctttggctttgccattgcattggagagttccaagaattgaagctagatggttcattgaagcctatgaacaagaagaaaacatgaacccaaccttgttgaagttagccaagttggatttcaacatggtccaatccatccaccaaaaagaaattggtgaattggcaagatggtgggttactactggtttggataagttggcttgggccagaaacaacttgttgcaatcctatatgtggtcttgcgctattgcttctgatccaaagtttaaattggccagagaaaccattgtcgaaatcggttctgttttgaccgttgttgatgatgcttatgatgtctacggtcatatggatgaattggacttgtacacctcttctgttgaaagatggtcctgcgccgaaattgataggttgccagacaccttgaagttgatcttcatgtccatgttcaacaagactaacgaagttggtttgagagttcaacacgaaagaggttacaactctatcccaacctttattaaggcttgggtcgaacaatgtaaatcttaccaaaaagaagctcgttggttccacggtggtcatactccaccattggaagaatattcattgaacggtttggtcagtatcggtttccctttgttgttgattactggttacattgctatcgctgaaaacgaagctgctttggacaaagttagaccattaccagatttgttgcactactccagtttgttgtccagattgatcaatgacatgggtacttctccagacgaaatggctagaggtgataacttgaaatctattcactgctacatgaacgaaaccggtgcttctgaagaagttgctagagaacatattaagggtatcatcgaagaaaactggaagatcttgaatcaatgctgcttcgaccaatctcaattccaagaaccattcatcactttcaacttgaactccgttagaggttcccatttcttttacgaatttggtgatggtttcggtgttactgattcttggacaaaagttgacatgaagtccgttttgattgacccaattccattaggtgaagaatga

SEQ ID NO: 309 - protein, 552 aa, Artificial Sequence
  Santalene synthase SaSSy-135
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGEKILDEAKAFATKYLKAMVESLGGHLAKRVKHALALPLHWRVPRIEARWFIEAYEQEENMNPTLLKLAKLDFNMVQSIHQKEIGELARWWVTTGLDKLAWARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 310 - protein, 552 aa, Artificial Sequence
  Santalene synthase SaSSy-136
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGEKILDEAKAFATKYLKAMVESLGSHLAKRVKHALALPLHWRVPRIEARWFIEAYEQEENMNPTLLKLAKLDFNMVQSIHQKEIGELARWWVTTGLDKLAWARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

SEQ ID NO: 311 - protein, 552 aa, Artificial Sequence
  Santalene synthase SaSSy-137
MAPAIVMSNYEEEEIVRRMGNYKPSIWNYDFLQSLATHHNIVEERHLKLAEKLKGQVRILLKEKMEPLAQLELVDVVQRLGLNHLLETEIKEALFSIYKDHIDSDKADLHATSLRFRLLRQQGIKISCDVFEQFKDDEDRFKSSLINDIQGMLSLYEASFLGWKGEDILDEAKAFATKYLKAMVESLGAHLAKRVKHALALPLHWRVPRIEARWFIEAYEQEENMNPTLLKLAKLDFNMVQSIHQKEIGELARWWVTTGLDKLAWARNNLLQSYMWSCAIASDPKFKLARETIVEIGSVLTVVDDAYDVYGHMDELDLYTSSVERWSCAEIDRLPDTLKLIFMSMFNKTNEVGLRVQHERGYNSIPTFIKAWVEQCKSYQKEARWFHGGHTPPLEEYSLNGLVSIGFPLLLITGYIAIAENEAALDKVRPLPDLLHYSSLLSRLINDMGTSPDEMARGDNLKSIHCYMNETGASEEVAREHIKGIIEENWKILNQCCFDQSQFQEPFITFNLNSVRGSHFFYEFGDGFGVTDSWTKVDMKSVLIDPIPLGEE

What is claimed:

1. A nucleic acid molecule encoding a modified santalene synthase polypeptide comprising the sequence of amino acids set forth in any of SEQ ID NOS: 244 or 309-311, or a nucleic acid molecule encoding a synthase that has at least 95% sequence identity to the sequence set forth in any of SEQ ID NOS: 244 or 309-311, wherein
the encoded modified santalene synthase polypeptide:
  i) catalyzes the production of total terpene product(s) from farnesyl diphosphate (FPP) in a host cell in an amount that is greater than the amount of the same total terpene products produced from FPP by the santalene synthase encoded by the sequence of nucleotides set forth in SEQ ID NO:3 in the same host cell and under the same conditions; or
  ii) catalyzes the production of terpene product(s) from farnesyl diphosphate (FPP) in a host cell with an altered product profile compared to the profile of the terpene products produced from FPP by the santalene synthase encoded by the sequence of nucleotides set forth in SEQ ID NO:3 in the same host cell and under the same conditions;
the host cell is a cell that produces FPP; and
the terpene product or products is a sesquiterpene.

2. The nucleic acid molecule of claim 1, wherein the terpene product(s) comprise α-santalene, α-exo-bergamotene, epi-β-santalene, β-santalene, or stereoisomers or mixtures thereof.

3. The nucleic acid molecule of claim 1, wherein increased percentages of santalenes are produced.

4. The nucleic acid molecule of claim 3, wherein the santalenes are α- and β-santalenes.

5. The nucleic acid molecule of claim 1, wherein the altered product profile comprises production of at least one terpene product that is increased by at least 1%, 2%, 3%, 4%, 5%, 6%, 7%, 8%, 9%, 10%, 15%, 20%, 25%, 30%, 35%, 40%, 50%, 60%, 70%, 80%, 90% or more compared to the production of the terpene product by the santalene synthase encoded by the sequence of nucleotides set forth in SEQ ID NO:3.

6. The nucleic acid molecule of claim 1, wherein the amount of total terpene products produced from FPP by the modified santalene synthase is at least about 105%, of the amount of total terpene products produced from FPP by the santalene synthase encoded by the sequence of nucleotides set forth in SEQ ID NO:3.

7. The nucleic acid molecule of claim 1 that is codon-optimized for expression in *Saccharomyces cerevisiae*.

8. A nucleic acid molecule encoding a modified santalene synthase polypeptide comprising the sequence of amino acids set forth in any of SEQ ID NOS: 244 or 309-311, or a nucleic acid molecule encoding a synthase that has at least 95% sequence identity to the sequence set forth in any of SEQ ID NOS: 244 or 309-311, wherein:
the modified santalene synthase catalyzes the production of total terpene product(s) from farnesyl diphosphate (FPP) in a host cell in an amount that is greater than the amount of the same total terpene products produced from FPP by the santalene synthase encoded by the sequence of nucleotides set forth in SEQ ID NO:3 in the same host cell and under the same conditions, wherein:
the host cell is a cell that produces FPP; and
the terpene product or products is a sesquiterpene.

9. A nucleic acid molecule encoding a modified santalene synthase polypeptide comprising the sequence of amino acids set forth in any of SEQ ID NOS: 244 or 309-311, or a nucleic acid molecule encoding a synthase that has at least 95% sequence identity to the sequence set forth in any of SEQ ID NOS: 244 or 309-311, wherein
the modified santalene synthase catalyzes the production of terpene products from farnesyl diphosphate (FPP) in a host cell with an altered product profile compared to the profile of the terpene products produced from FPP by the santalene synthase encoded by the sequence of nucleotides set forth in SEQ ID NO:3 in the same host cell and under the same conditions, wherein:
the host cell is a cell that produces FPP; and
the terpene product or products is a sesquiterpene.

10. A host cell, comprising a nucleic acid molecule of claim 1, wherein, if the cell is human, it is isolated.

11. A vector, comprising the nucleic acid molecule of claim 1.

12. The vector of claim 11, wherein the vector is a prokaryotic vector, a viral vector, or an eukaryotic vector.

13. The vector of claim 11, wherein the vector is a yeast expression vector.

14. A host cell, comprising the vector of claim 11, wherein, if the cell is human, it is isolated.

15. The host cell of claim 14 that is selected from among a bacterial, yeast, insect, plant and mammalian cell.

16. The host cell of claim 15 that is a *Saccharomyces cerevisiae* cell or an *Escherichia coli* cell.

17. The host cell of claim 15 that produces farnesyl diphosphate (FPP) or is modified to produce more FPP compared to an unmodified cell.

18. The host cell of claim 15, comprising a nucleic acid encoding a cytochrome P450 oxidase and optionally a cytochrome P450 reductase.

19. A transgenic plant, comprising the nucleic acid molecule of claim 1.

20. A method for producing a modified santalene synthase polypeptide, comprising:
culturing a cell comprising the nucleic acid molecule of claim 1 under conditions suitable for expression of the modified santalene synthase polypeptide encoded by the nucleic acid molecule; and optionally isolating the modified santalene synthase.

21. A modified santalene synthase polypeptide encoded by the nucleic acid molecule of claim 1.

22. A method of producing a terpene product, comprising:

contacting an acyclic pyrophosphate terpene precursor with a modified santalene synthase polypeptide of claim 21, under conditions suitable for the formation of terpene products from the acyclic pyrophosphate terpene precursor to thereby catalyze production of a terpene product or a mixture of terpene products; and optionally isolating the terpene product(s).

23. The method of claim 22, wherein the step of contacting the acyclic pyrophosphate terpene precursor with the modified santalene synthase polypeptide is effected in vitro or in vivo in an host cell.

24. The method of claim 23, wherein the acyclic pyrophosphate terpene precursor is selected from among farnesyl diphosphate (FPP), geranyl diphosphate (GPP) and geranylgeranyl diphosphate (GGPP).

25. The method of claim 22, further comprising:

processing a resulting terpene or terpene mixture to its respective alcohol or mixture of alcohols; and optionally isolating the alcohol or mixture of alcohols.

* * * * *